US011185573B2

(12) United States Patent
Howard

(10) Patent No.: US 11,185,573 B2
(45) Date of Patent: Nov. 30, 2021

(54) ALLELIC VARIANTS OF HUMAN FACTOR VIII

(71) Applicant: Haplomics, Inc., Brownsville, TX (US)

(72) Inventor: Thomas E. Howard, Brownsville, TX (US)

(73) Assignee: Haplomics, Inc., Brownsville, TX (US)

( * ) Notice: Subject to any disclaimer, the term of this patent is extended or adjusted under 35 U.S.C. 154(b) by 4 days.

(21) Appl. No.: 16/361,027

(22) Filed: Mar. 21, 2019

(65) Prior Publication Data
US 2019/0307854 A1 Oct. 10, 2019

Related U.S. Application Data

(63) Continuation of application No. 14/691,544, filed on Apr. 20, 2015, now abandoned, which is a continuation of application No. 11/720,945, filed as application No. PCT/US2005/044229 on Dec. 6, 2005, now abandoned.

(60) Provisional application No. 60/737,779, filed on Nov. 16, 2005, provisional application No. 60/634,065, filed on Dec. 6, 2004.

(51) Int. Cl.
A61K 38/37 (2006.01)
C07K 14/755 (2006.01)
C12Q 1/68 (2018.01)
C12Q 1/6883 (2018.01)

(52) U.S. Cl.
CPC ............ A61K 38/37 (2013.01); C07K 14/755 (2013.01); C12Q 1/6883 (2013.01); C12Q 2600/106 (2013.01); C12Q 2600/156 (2013.01); C12Q 2600/158 (2013.01); C12Q 2600/172 (2013.01)

(58) Field of Classification Search
None
See application file for complete search history.

(56) References Cited

U.S. PATENT DOCUMENTS

| 4,981,957 A | 1/1991 | Lebieu et al. |
| 5,118,800 A | 6/1992 | Smith et al. |
| 5,149,637 A | 9/1992 | Scandella et al. |
| 5,319,080 A | 6/1994 | Leumann |
| 5,359,044 A | 10/1994 | Cook et al. |
| 5,364,771 A | 11/1994 | Lollar et al. |
| 5,393,878 A | 2/1995 | Leumann |
| 5,446,137 A | 8/1995 | Maag et al. |
| 5,466,786 A | 11/1995 | Buhr et al. |
| 5,514,785 A | 5/1996 | Van Ness et al. |
| 5,519,134 A | 5/1996 | Acevedo et al. |
| 5,567,811 A | 10/1996 | Misiura |
| 5,576,427 A | 11/1996 | Cook et al. |
| 5,583,209 A | 12/1996 | Loilar et al. |
| 5,591,722 A | 1/1997 | Montgomery et al. |
| 5,597,909 A | 1/1997 | Urdea et al. |
| 5,610,300 A | 3/1997 | Altmann et al. |
| 5,627,053 A | 5/1997 | Usman et al. |
| 5,639,873 A | 6/1997 | Barascut et al. |
| 5,646,265 A | 7/1997 | McGee |
| 5,658,873 A | 8/1997 | Bertsch-Frank et al. |
| 5,659,017 A | 8/1997 | Bhattacharya et al. |
| 5,663,060 A | 9/1997 | Lollar et al. |
| 5,670,633 A | 9/1997 | Cook et al. |
| 5,700,920 A | 12/1997 | Altmann et al. |
| 5,744,446 A | 4/1998 | Lollar et al. |
| 5,859,204 A | 1/1999 | Lollar |
| 5,888,974 A | 3/1999 | Lollar et al. |
| 6,180,371 B1 | 1/2001 | Lollar |
| 6,261,834 B1 | 7/2001 | Srivastava |
| 6,376,463 B1 | 4/2002 | Lollar |
| 6,458,563 B1 | 10/2002 | Lollar et al. |
| 6,517,830 B1 | 2/2003 | Lollar et al. |
| 6,759,216 B1 | 7/2004 | Lollar |
| 6,770,744 B2 | 8/2004 | Lollar |
| 6,852,537 B2 | 2/2005 | Hebbel et al. |
| 7,037,658 B2 | 5/2006 | Ginsburg et al. |
| 7,517,522 B2 | 4/2009 | Ginsburg et al. |
| 2004/0096456 A1 | 5/2004 | Conti-Fine |
| 2005/0256304 A1 | 5/2005 | Jones |
| 2006/0228758 A1 | 10/2006 | Muchhal et al. |
| 2009/0317375 A1 | 12/2009 | Wagner et al. |
| 2010/0168018 A1 | 7/2010 | Pikal et al. |
| 2010/0256062 A1 | 10/2010 | Howard et al. |
| 2011/0177107 A1 | 7/2011 | Howard |
| 2012/0149115 A1 | 6/2012 | Kim et al. |
| 2015/0023959 A1 | 1/2015 | Chhabra et al. |
| 2015/0196017 A1 | 7/2015 | Howard et al. |
| 2015/0197552 A1 | 7/2015 | Howard et al. |

(Continued)

FOREIGN PATENT DOCUMENTS

| EP | 0302968 A1 | 2/1989 |
| WO | 1993/003367 A1 | 2/1993 |

(Continued)

OTHER PUBLICATIONS

Howard, T., et al. 2004 African-Americans express multiple haplotypic forms of the wildtype factor VIII (FVIII) protein: A possible role for pharmacogenetics in FVIII inhibitor development?, Blood (American Society of Hematology Abstract), 104: 384. (1 page). (Year: 2004).*

Bhopale, G.M., et al. 2003 J Biosci 28: 783-789. (Year: 2003).*

Higuchi, M., et al. 1991 Proceedings of the National Academy of Sciences 88: 7405-7409. (Year: 1991).*

Higuchi, M., et al. 1991 Proceedings of the National Academy of Sciences 88: 8307-8311. (Year: 1991).*

Howard; Pharmacogenetics and Coagulation Factor VIII Inhibitors; Is there a Causual Role Presentation at American Society of Hematology Meeting, San Diego, CA Dec. 6, 2004.

Sugihara, Keiko, et al. "Thrombospondin mediates adherence of CD36+ sickle reticulocytes to endothelial cells." Blood (1992): 80.10: 2634-2642.

(Continued)

Primary Examiner — Marsha Tsay

(74) Attorney, Agent, or Firm — Denise L. Mayfield; Dykema Gossett PLLC

(57) ABSTRACT

Disclosed are compositions and methods related to Factor VIII.

10 Claims, 11 Drawing Sheets

Specification includes a Sequence Listing.

(56) References Cited

U.S. PATENT DOCUMENTS

| | | |
|---|---|---|
| 2015/0216944 A1 | 7/2015 | Howard et al. |
| 2015/0306250 A1 | 10/2015 | Laterza et al. |
| 2016/0038570 A1 | 2/2016 | Howard et al. |
| 2016/0038575 A1 | 2/2016 | Howard et al. |
| 2016/0045575 A1 | 2/2016 | Howard et al. |
| 2016/0168593 A1 | 6/2016 | Cost et al. |

FOREIGN PATENT DOCUMENTS

| | | |
|---|---|---|
| WO | 1997/003195 A1 | 1/1997 |
| WO | 1998/052976 A1 | 11/1998 |
| WO | 2000/017375 A2 | 3/2000 |
| WO | 2004/037977 A2 | 5/2004 |
| WO | 2006/063031 A2 | 6/2006 |
| WO | 2011/046568 A1 | 4/2011 |
| WO | 2011/088391 A2 | 7/2011 |
| WO | 2012/051343 A1 | 4/2012 |
| WO | 2012/058480 A1 | 5/2012 |
| WO | 2014/089541 A1 | 6/2014 |
| WO | 2014/145524 A2 | 9/2014 |
| WO | 2014/186585 A2 | 11/2014 |
| WO | 2015/054439 A2 | 4/2015 |
| WO | 2015/148454 A1 | 10/2015 |
| WO | 2015/191899 A1 | 12/2015 |
| WO | 2017/112895 A1 | 6/2017 |

OTHER PUBLICATIONS

Sun, Ning, et al. "Recent advances in targeted genome engineering in mammalina systems." Biotechnology Journal (2012): 7.9: 1074-1087.

Toole et al., A larger region (≈95 kDa) of human factor VIII is dispensable for in vitro procoagulant activity, Proc. Natl. Acad. Sci. USA, 83:5939-5942 (1986).

Tsai, Han-Nou. "Pathophysiology of thrombotic thrombocytopenic purpura." International Journal of Hematology (2010); 91(1) 1-19.

Tuddenham, Edward GD, et al., "Haemophilia A: database of nucleotide substitutions, deletions, insertions and rearrangement of the factor VIII gene." Nucleic Acids Research (1994); 22.22 4851-4868.

Turner and Moake, "Factor III Is Synethesized in Human Endothelial Cells, Packaged in Weibel-Palade Bodies and Secreted Bound to ULVWF Strings." PLoS One (2015); 10(10): e0140740, pp. 1-28.

UniProt Submission FA8_HUMAN titled. Coagulation factor VIII. Mar. 6, 2013; p. 1, 22-23, 39, 20 pages.

Van De Water et al.. Amplification of a 29.7 kb Region of the Factor VIII Gene Using the Expand PCR System, Biochemica, 2:11-12 (1996).

Venter et al., The sequence of the human genome, Science, 291:304-1351 (2001).

Viel et al., Inhibitors of Factor VIII in Black Patients with Hemophilia, N. Engl. J. Med., 360:1618-1627 (2009).

Walsh, Biopharmaceutical benchmarks 2010, Nat. Biotechnol., 28(9):917-924 (2010).

Wang et al., A Systematic Assessment of MHC Class II Peptide Binding Predictions and Evaluation of a Consensus Approach, PLoS Comput. Biol., 4(4):e1000048 (2008).

Ware et al., Epitope mapping of human factor VIII inhibitor antibodies by site-directed mutagenesis of a factor VIII polypeptide. Blood Coagul. Fibrinolysis, 3(6):703-716 (1992).

Wautier et al., Fibrinogen, a modulator of erythrocyte adhension to vasuclar endothelium, J. Lab. Clin. Med., 101:911-20 (1983).

Wick et al., Unusually Large von Willebrand Factor Multimers Increase Adhension of Sickle Erythrocytes to Human Endothelial Cells under Controlled Flow, J Clin. Invest., 80:905-910 (1987).

Wittwer et al., High-resolution genotyping by amplicon melting analysis using LCGreen, Clin. Chem., 49(6):853-860 (2003).

Wu et al., "In situ genetic correction of F8 intron 22 inversion in hemophilia A patient-specific iPSCs." Nature Scientific Reports (2016); 6: Article No. 18865, 11 pages.

Zou, Jizhong, et al. "Oxidase-deicient neutrophils from X-linked chronic granulomatous disease iPS cells: functional correction by zine finger nuclease-mediated safe harbor targeting." Blood (2011); 117.21 5561-5572.

Antonarakis et al., Factor VIII gene inversions in severe hemophilia A: results of an international consortium study, Blood, 86:2206-2212(1995).

Astermark et al., Polymorphisms in the TNFA gene and the risk of inhibitor development in patients with hemophilia A Blood, 108(12):3739-3745 (2006).

Bagnall et al., Recurrent inversion breaking from intron 1 of the factor VIII gene is a frequent cause of severe hemophilia A, Blod, 99:168-174 (2002).

Ballas, Complications of sickle cell anemia in adults: Guidelines for effective management, Cleveland Clin. J Med., 86(1):48-58 (1999).

Banerji et al., A lymphocyte-specific cellular enhancer is located downstream of the joining region in immunoglobulin heavy chain genes, Cell, 33:729-740 (1983).

Marfaing-Koka et al.. Decreased protein S activity in sickle cell disease, Nouv. Rev. Fr. Hamatal., 35:425-430 (1993).

Lotta et al., ADAMTS13 mutations and polymorphisms in congenital thrombotic thrombocytopenic purpura, Human Mutation, 31(1):11-19 (2010).

Matsui, et al., "Ex Vivo Gene Therapy for Hemophilia A that Enhances Safe Delivery and Sustained in Vivo Factor VII Expression from Lentivirally Engineered Endothelial Progenitors." Stem Cells (2007); 25 (10): 2660-2669.

Meyer et al., Signatures of Demographic History and Natural Selection in the Human Major Histocompatibility Complex Loci, Genetics, 173:2121-2142 (2005).

Meyer et al., The ADAMTS13 gene as the immunological culprit in acute acquired TIP—first evidence of genetic outbreeding depression in humans, Blood, (ASH Annual Meeting Abstracts), 110:227 (2007) Abstract.

Nielsen et al., Sequence-selective recognition of DNA by strand displacement with a thymine-substituted polyamide, Science, 254:1497-1500 (1991).

Oldenburg et al., Genetic rish factors for inhibitors to factors VIII and IX, Hemophilia, 12(6):15-22 (2006).

Park, et al., "Targeted inversion and revision of the blood coagulation factors gene in human iPS cells using TALENs." PNAS (2014); 111 (25): 9253-9258.

Powell, Jerry S., et al., "Phase 1 trial of FVIII gene transfer for severe hemophilia A using a retroviral construct administered by peripheral intravenous infusion." Blood (2003); 102.6:2038-2045.

Ragot et al., Replication-defective recombinant adenovirus expressing the Epstein-Barr virus (EBV) envelope glycoprotein gp340/220 induces protective immunity against EBV-induced lymphomas in the cottontop tamarin, J. General Viroloy, 74:501-507 (1993).

Repressé et al., "Factor VIII (FVIII) gene mutations in 120 patients with hemophilia A: detection of 26 novel mutations and correlation with FVIII inhibitor development." J. Thrombosis and Haemostasis (2007); 5: 1469-1476.

Rocino et al., Successful immune tolerance treatment with monoclonal or recombinant factor VIII concentrates in high responding inhibitor patients, Vox Sang., 77(1):65-69 (1999).

Rocino et al., Immune tolerance induction in haemophilia A patients with high-responding inhibitors to factor VIII: experience at a single institution, Haemophilia, 7(1):33-38 (2001).

Scandella et al., A recombinant factor VIII A2 domain polypeptide quantitatively neutralizes human inhibitor antibodies that bind to A2, Blood, 82:1767-1775 (1993).

Scandella et al., A soluble recombinant factor VIII fragment containing the A2 domain binds to some human anti-factor VIII antibodies that are not detected by immunoblotting, Throm. Haemostas., 67(6):665-671 (1992).

Scandella et al. Epitope mapping of human factor VIII inhibitor antibodies by deletion analysis of factor VIII fragments expressed in *Escherichia coli*, Proc Natl Acad. Sci. USA, 85:6152-6156 (1988).

Solheim, et al., "Viral safety of solvent/detergent-treated plasma." Transfusion (2000); 40(1): 84-90.

(56) References Cited

OTHER PUBLICATIONS

Steere et al., Antibiotic-refractory Lyme arthritis is associated with HLA-DR molecules that bind a Borrelia burgdorferi peptide, J. of Experimental med., 203(4):961-971 (2006).
Sugihara et al., Thrombospondin mediates adherence of CD36+ sickle reticulocytes to endothelial cells, Blood, 80 (10):2634-2642 (1992).
PCT/US2005/044229, International Search Report and Written Opinion dated Sep. 30, 2008, 10 pages.
PCT/US2005/044229, International Preliminary Report on Patentability dated Mar. 3, 2009, 6 pages.
PCT/US2009/061075, International Search Report and Written Opinion dated Aug. 5, 2010, 11 pages.
PCT/US2009/061075, International Preliminary report on Patentability dated Apr. 17, 2012, 7 pages.
PCT/US2011/021394, International Search Report and Written Opinion dated Jul. 15, 2011, 24 pages.
PCT/US2011/021394, International Preliminary Report and Patentability dated Jul. 15, 2012, 17 pages.
PCT/US2013/073751, International Search Report and Written Opinion dated Nov. 20, 2014, 13 pages.
PCT/US2014/030314, International Search Report dated Oct. 24, 2014, 5 pages.
PCT/US2014/030314, Written Opinion dated Oct. 24, 2014, 7 pages.
PCT/US2014/030314, International Preliminary Repor ton Patentability dated Sep. 15, 2015, 8 pages.
PCT/US2014/059787, International Search Report and Written Opinion dated Apr. 10, 2015, 12 pages.
PCT/US2014/059787, International Preliminary Report on Patentability dated Apr. 12, 2016, 8 pages.
PCT/US2015/035399, International Search Report and Written Opinion dated Aug. 27, 2015, 17 pages.
PCT/US2015/035399, International Preliminary Report on Patentability dated Dec. 15, 2016, 13 pages.
PCT/US2016/068402, International Search Report and Written Opinion dated Apr. 13, 2017, 12 pages.
Howard II, 2005 Blood 106: 3207 abstract (3 pages).
Howard III, 2006 108: 765 abstract (3 pages).
Higuchi, M., et al. 1991 Proc Natl Acad Sci 88: 7405-7409.
Higuchi, M., et al. 1991 Proc Natl Acad Sci 88: 8307-8311.
Hay, C.R.M., et al. 2000 British Journal of Haematology 111: 78-90.
Barbosa et al., Clinical link between MHC class II haplotype and interferon-beta (IFN-β) immunogenicity, Clin. Immunol., 118:42-50 (2006).
Bi et al., Targeted disruption of the mouse factor VIII gene produces a model of haemophilia A, Nat. Genet., 10 (1):119-121 (1995).
Bongers et al., Lower levels of ADAMTS13 are associated with cardiovascular disease in young patients, Atherosclerosis, 207(1):250-254 (2009).
CDC Mutation List, 315 pages, prepared by Examiner in 2017.
DeGroot et al., Reducing risk, improving outcomes: Bioengineering less immunogenic protein therapeutics, Clin. Immunol., 101:189-201 (2009).
DeGroot et al., Prediction of immunogenicity: in silico paradigms, ex vivo and in vivo correlates, Curr. Opin. Pharmacol., 8:620-626 (2008).
Edwards, et al., "Characterization of Coding Synonymous and Non-Synonymous Variants in ADAMTS13 Using Ex Vivo and In Silico Approaches." PLoS One (2012); 7:1-15.
Elenitoba-Johnson et al., Solution-based scanning for single-based alterations using a double-stranded DNA binding dye and flourescence-melting profiles, Am. J. Pathol., 159(3):845-853 (2001).
Elmahmoudi, Hejer, et al. "Factor VIII haplotypes frequencies in Tunisian hemophiliacs A." Diagnostic Pathology (2011); 6:1: 54, pp. 1-4.
EP Application No. 13860153.9, Extended European Search Report dated Jun. 13, 2016, 10 pages.
EP Application No. 14765535.1, Extended European Search Report dated Oct. 27, 2016, 11 pages.

EP Application No. 14765535.1, Partial European Search Report dated Jul. 7, 2016, 5 pages.
EP Application No. 15807028.4, Extended European Search Report dated Nov. 30, 2017, 8 pages.
Frazer et al., A second generation human halotype map of over 3.1 million SNPs, Nature, 449:851-861 (2007).
Fulcher et al. Localization of human factor FVI11 inhibitor epitopes to two polypeptide fragments, Proc. Natl. Acad. Sci. USA, 82:7728-7732 (1985).
GenBank Assession No. U00684.1 dated Nov. 30, 1993.
Ghosh et al., Immune Response to FVIII in hemophilia A: an overview of risk factors, Clinic Rev. Allergy and Immunol, 37(2):58-66 (2009).
Goudemand, Pharmoaco-economic aspects of inhibitor treatment, Eur. J. Haematol. Suppl., 61(63):24-27 (1998).
Graw et al., Haemophilia A., From Mutation Analysis to New Therapies, Nat. Rev. Genet., 6:488-501 (2005).
Gundry et al., Amplicon Melting Analysis with Labeled Primers: A Closed-Tube Method for Differentiating Homozygotes and Heterozygotes, Clin. Chem., 49(3):396-406 (2003).
Hay, C.R.M, et al. "The Diagnosis and Management of Factor VIII and IX Inhibitors [colon] A Guideline From the UK Haemophilia Centre Doctors [APOS] Organization (UKHCDO)." British Journal of Haematology (2000); 111.1: 78-90.
Higuchi, Miyoko, et al. "Molecular characterization of mild-to-moderated hemophilia A: detection of the mutation in 25 of 29 patients by by denaturing gradient gel electrophoresis." Proceedings of the National Academy of Sciences (1991); 88. 19:8307-8311.
Higuchi, Miyoko, et al. "Molecular characterization of severe hemophilia A suggests that about half the mutations are not within the coding regions and splice junctions of the factor VIII gene." Proceedings of the National Academy of Sciences (1991); 88.16: 7405-7409.
Hillery et al., The Carboxy-Terminal Cell-Binding Domain of Thrombospondin Is Essential for Sickel Red Blood Cell Adhesion, Blood, 94:302-309 (1999).
Hillery et al., Increased adhesion of erythrocytes to components of the extracellular matrix: isolation and characterization of red blood cell lipid that binds thrombospondin and laminin, Blood, 87:4879-4886 (1996).
Howard et al., African-American express multiple haplotypic forms of the wildtype factor VIII (FVIII) protein: A possible role for pharmacogenetics in the FVIII inhibitor development?, Blood (American Society of Hematology Abstract), 104:384 (2004).
http://habd.org.uk Oct. 2003; internet date: Apr. 4, 2012.
http://tools.immuneepitope.org/analyze/html/mhc_binding.html, internet date: Sep. 18, 2012.
International Search Report and Written Opinion for Application No. PCT/US2005/044229 dated Sep. 30, 2008.
International Search Report and Written Opinion for Application No. PCT/US2009/061075 dated Apr. 17, 2012.
International Search Report and Written Opinion for Application No. PCT/US2011/021394 dated Jul. 15, 2011.
Jacquemin, Marc, et al. "CD4+ T-cell clones specific for wild-type factor VIII: a molecular mechanism responsible for a higher incidence of inhibitor formation in mild/moderate hemophilia A." Blood (2003); 191.4: 1351-1358.
Jinkurtar et al. Challenges in Delivery of Therapeutic Genomics and Proteomics. Elsevier (2011); Chapter 2, pp. 46-54, 12 pages.
Kasschau et al., Adhesion of sickle neutrophils and erythrocytes to fibronectin, Blood, 87:771-780 (1996).
Kaul et al., Sickle erythrocyte-endothelial interactions in microcirculation: the role of von Willebrand factor and implications for vasoocclusion, Blood, 81:2429-2483 (1993).
Kemball-Cook et al., The Factor VIII Structure and Mutation Resource Site: HAMSTeRS Version 4, Nucleic Acids Res., 26:216-219(1998).
Koren et al., "Clinical validation of the "in silica" prediction of immunogenicity of a human recombinant therapeutic protein." Clinical Immunology (2007); 124(1): 26-32.
Kreuz et al., Epidemiology of inhibitors and current treatment strategies, Haematologica, 88(6):EREP04 (2003) (abstract).

(56) References Cited

OTHER PUBLICATIONS

Lay et al., Real-time fluorescence genotyping of factor V Leiden during rapid-cycle PCR, Clin. Chem., 43 (12):2262-2267 (1997).

Lazarski et al., The Kinetic Stability of MHC Class II: Peptide Complexes Is a Key Parameter that Dictates Immunodominance, Immunity, 23:29-40 (2005).

Lee et al., Sickle Cell Adhesion to Laminin: Potential Role for the q5 Chain, Blood, 92:2951-2958 (1998).

Lee, Michael, et al. "Genotyping of single-nucelotide polymorphisms by high-resolution melting of small amplicons." Clinical Chemistry (2004); 50.7: 1156-1164.

Lee et al. Targeted chromosomal duplications and inversions in the human genome using zinc finger nucleases. Genome Res Mar. 2012 vol. 22 No. 3 pp. 539-548 with online Supplementary Information included, Especially p. 539 col. 2 para 3, p. 544 col. 2 para 2, p. 544 fig 4, p. 5445 col. 1 para 1.

Liew et al., Genotyping of single-nucleotide polymorphisms by high-resolution melting of small amplicons, Clin. Chem., 50(7): 1156-1164 (2004).

Lin, Yi, et al. "Use of blood outgrowth endothelial cells for gene therapy for hemophilia A." Blood (2002); 99:2. 457-462.

Lipsky et al., DNA Melting Analysis for Detection of Single Nucleotide Polymorphisms, Clin. Chem., 47(4):635-644 (2001).

Lollar et al., Inhibition of Human Factor VIIIa by Anti-A2 Subunit Antibodies, J. Clin. Invest., 93:2497-2504 (1994).

\* cited by examiner

Figure 1 (continued)
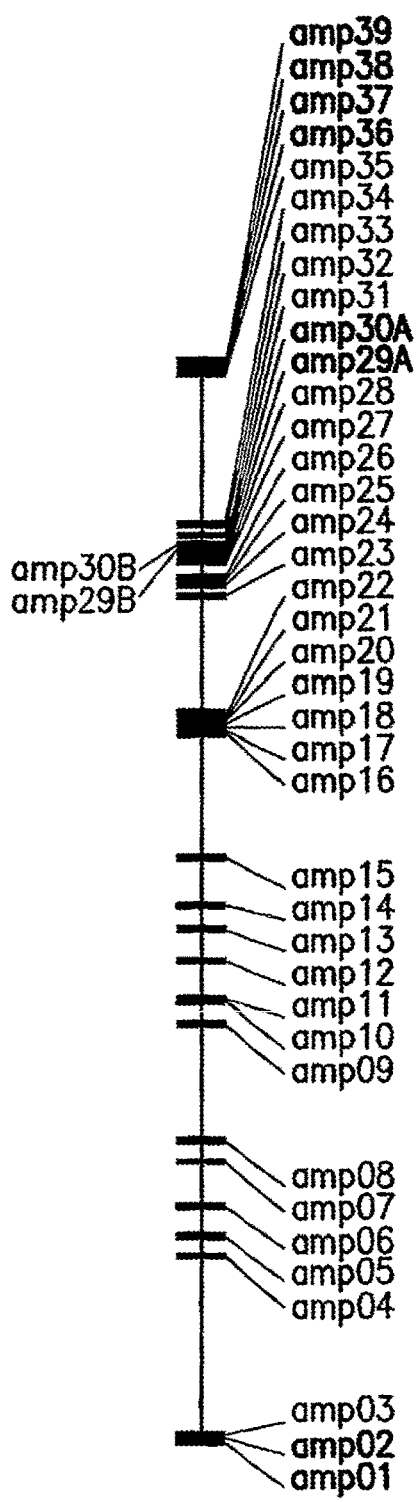
FIG. 1D
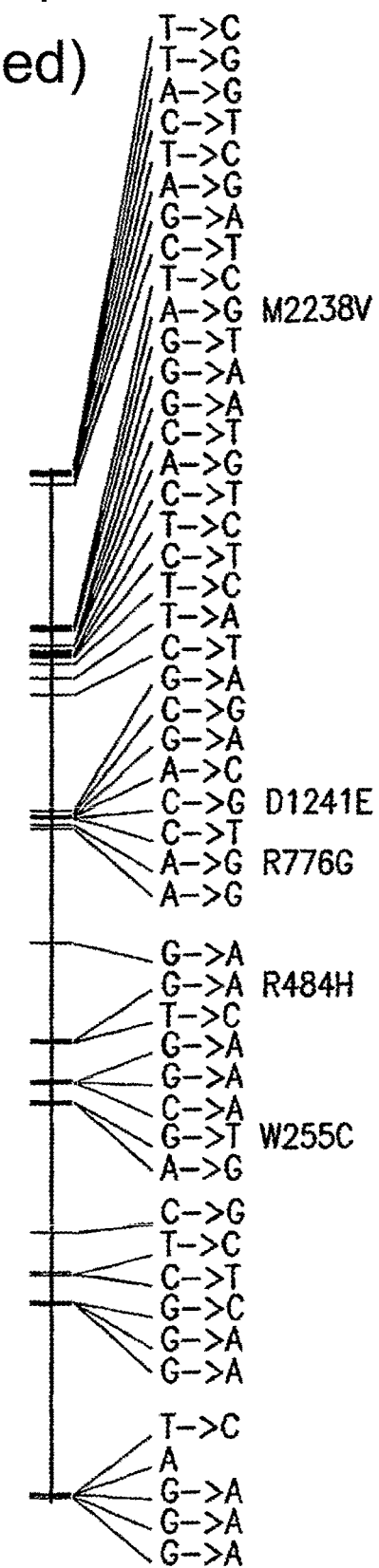
FIG. 1E

| H | Wildtype Human FVIII Proteins | Ethnicities | $f_{AA}$ | $f_C$ | $f_A$ | $f_{SEA}$ |
|---|---|---|---|---|---|---|
| 1 | (W)(R)(R)(D) Ca²⁺ (M)* | CA,AA,MI,SEA, SAA,J,C | 35% | 93% | 87% | 85% |
| 2 | (W)(R)(R)(E) Ca²⁺ (M)* | AA,CA,MI,SAA, J,Primates | 38% | 7% | 5% | 5% |
| 3 | (W)(R)(R)(E) Ca²⁺ (V)* | AA | 22% | | | |
| 4 | (W)(H)(R)(E) Ca²⁺ (M)* | AA | 4% | | | |
| 5 | (W)(R)(R)(D) Ca²⁺ (V)* | AA | 1% | | | |
| 6 | (W)(R)(G)(E) Ca²⁺ (M)* | C | 8% | | | |
| 7 | (C)(R)(R)(E) Ca²⁺ (M)* | SEA | 10% | | | |

Figure 3

Figure 5
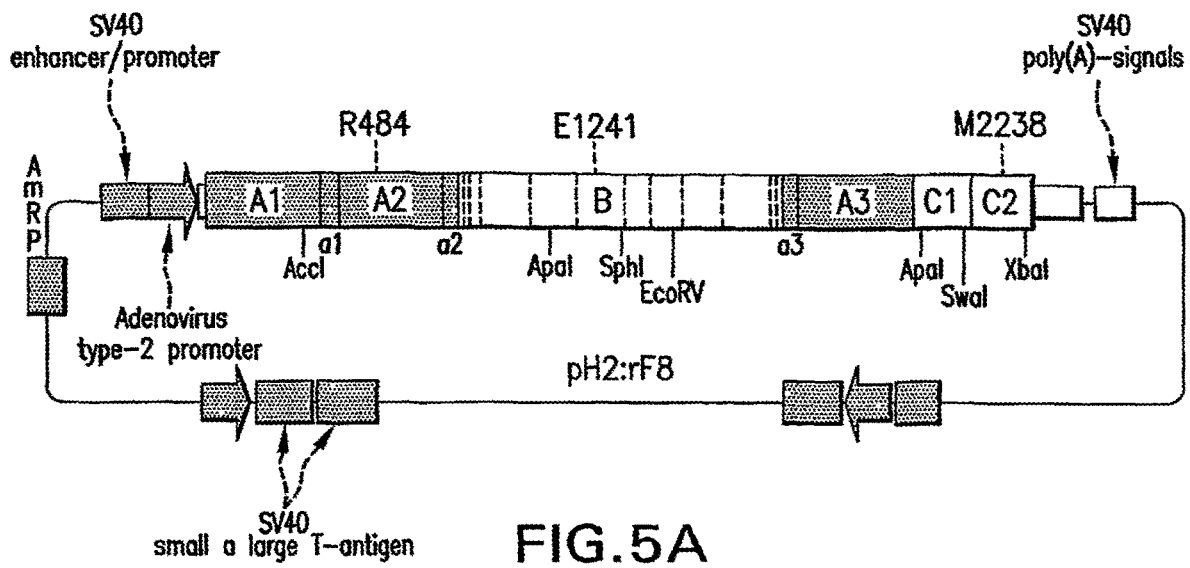
FIG.5A
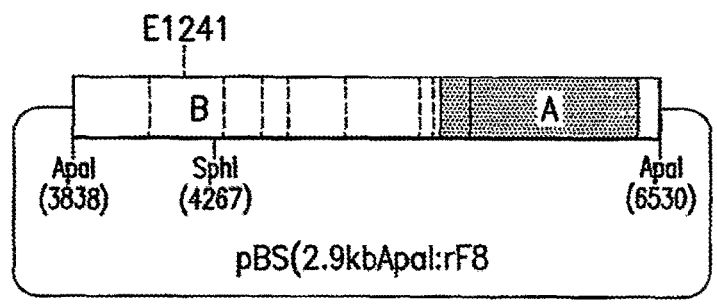
FIG.5B
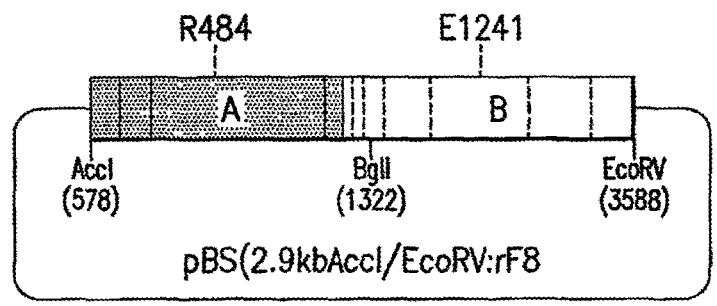
FIG.5C

ALLELIC VARIANTS OF HUMAN FACTOR VIII

CROSS REFERENCE TO RELATED PATENT APPLICATIONS

This application is a continuation of U.S. patent application Ser. No. 14/691,544, filed Apr. 20, 2015, which is a continuation of U.S. patent application Ser. No. 11/720,945, which is the National Stage of International Application No. PCT/US2005/044229, filed Dec. 6, 2005, which claims the benefit of U.S. Provisional Application No. 60/737,779, filed Nov. 16, 2005, and U.S. Provisional Application No. 60/634,065, filed Dec. 6, 2004, all of each of which are incorporated herein by reference in their entireties.

STATEMENT REGARDING SEQUENCE LISTING

The Sequence Listing associated with this application is provided in text format in lieu of a paper copy, and is hereby incorporated by reference into the specification. The name of the text file containing the Sequence Listing is HPLO_002_04US_ST25.txt. The text file 1,758 KB, was created on Mar. 20, 2019, and is being submitted electronically via EFS-Web.

BACKGROUND

Hemophilia is a congenital bleeding disorder. Patients with Hemophilia A have either absent, decreased or defective production of the blood clotting protein, Factor VIII (FVIII). Those with Hemophilia B have similar problems with Factor IX (FIX). Hemophilia is characterized as "severe" when the activity of the affected clotting factor (FVIII or FIX) is less than 1% of normal. Severe Hemophilia is often associated with spontaneous bleeding (i.e. bleeding not caused by trauma or injury). Hemophilia is termed "mild" when the relevant clotting factor activity is 6-24% of normal. Hemophilia is referred to as "moderate" when clotting factor activity is between 1% and 5% of normal. Approximately 70% of Hemophilia patients have severe disease and can require treatment for bleeding several times per month.

Most patients that have Hemophilia A or B are treated by replacing their missing coagulation factor with FVIII or FIX that is either derived from plasma or developed using recombinant technology. One of the most serious complications of the treatment of Hemophilia is the development of 'inhibitors'. 'Inhibitors' are antibodies to FVIII or FIX that can develop in patients with Hemophilia following replacement therapy with the missing coagulation factor. The management of Hemophilia patients with inhibitors is difficult. Clinically, most inhibitors are detected when patients fail to respond to standard replacement therapy. Inhibitor levels are measured in Bethesda units (BU). In general a patient having a BU exceeding 10 is considered refractory to treatment with human FVIII.

Inhibitors are usually first detected using a sensitive clotting-based assay, variably referred to as an inhibitor screen or a mixing study. The coagulation factor specificity of the suspected inhibitor is next commonly determined by performing a set of clotting-based factor activity assays where each is specific for one of the candidate coagulation proteins potentially being targeted. The presence and specificity of an inhibitor is most often confirmed by performing the more specific clotting-based test known as the Bethesda assay. The plasma level (i.e. titer) of an inhibitor, likewise, is typically measured by the Bethesda assay, and is defined in terms of Bethesda units (BU).

Acquired Hemophilia is a spontaneous development of inhibitors to one's own FVIII. Acquired Hemophilia occurs in about one person per million. The underlying cause of inhibitor development in acquired hemophilia is unknown but is associated with many conditions including pregnancy, autoimmune disease, the use of certain medications or cancer Acquired Hemophilia A: A Concise Review Franchini et. al. American Journal of Hematology 80:55-63 (2005). Patients with acquired Hemophilia may present to the hospital as a result of a severe spontaneous bleeding episode. These bleeding episodes are very difficult to control, and will not typically respond to treatment with FVIII.

Treatment of Hemophilia patients (both A and B) and patients with other coagulation factor deficiencies is normally based on replacement therapy (substitution of the missing clotting factor).

The replacement clotting factors are typically obtained from human plasma or from recombinant (genetically engineered) preparations. Human plasma-derived clotting factors have the inherent risk of potentially transmitting certain viruses. Antibodies or 'inhibitors' can develop following treatment with either human plasma factor concentrates or recombinant clotting factor preparations. Alloantibodies react with the replacement fVIII product but not with the patient's endogenous fVIII. Occasionally patients develop autoantibodies in addition ti alloantibodies in response to infused fVIII. When this occurs a mild or moderate patient may become a severe patient. The development of inhibitors is very problematic as injected replacement therapy is frequently 'neutralized' or made ineffective by the inhibitor shortly after infusion. Treatment options are available for treating Hemophilia patients that develop inhibitors include are high dose FVIII or FIX treatment (to overcome the inhibitor), for hemophilia A NonvoSeven (rfVIIa) porcine FVIII (FVIII derived from the plasma of pigs) or bypassing agents such as prothrombin complex concentrates (PCCs) or activated prothrombin complex concentrates (e.g., FEIBA and other APCCs) which enhance the hemostatic process without the need of FVIII or FIX.

FVIII is also associated with other diseases and disorders, as outlined below. Elevated levels of FVIII are an important risk factor for venous thrombosis and may also be associated with arterial thrombosis. Thrombosis is the formation of a clot or thrombus inside a blood vessel, obstructing the flow of blood through the circulatory system. Thromboembolism is a general term describing both thrombosis and its main complication: dislodgement of a clot and embolization. Von Willebrand's disease is due to an abnormality, either quantitative or qualitative, of the Von Willebrand factor (vWF), which is a large multimeric glycoprotein that functions as the carrier protein for factor VIII (FVIII). vWF also is required for normal platelet adhesion. As such, vWF functions in both primary (involving platelet adhesion) and secondary (involving FVIII) hemostasis. In primary hemostasis, vWF binds on platelets to its specific receptor glycoprotein Ib and acts as an adhesive bridge between the platelets and damaged subendothelium at the site of vascular injury. In secondary hemostasis, vWF protects FVIII from degradation and delivers it to the site of injury. What is needed in the art are methods and compositions for screening for and treating diseases and disorders related to FVIII and in the case of hemophilia A less antigenic and less immunogenic fVIII replacement preparations and in the case of prothombotic fVIII improved means to neutralize coagulant activity.

SUMMARY

Disclosed is a method of categorizing a haplotype in a FVIII gene comprising, amplifying regions of the FVIII gene, determining a haplotype of the FVIII gene from DNA sequence within the amplified regions, and categorizing the haplotype as being an H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6).

Disclosed is a method of categorizing a haplotype in a FVIII gene comprising, detecting a FVIII protein and categorizing the haplotype of the FVIII gene encoding the detected FYIII protein as being an H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6).

Disclosed is a method of reducing the generation of anti-FVIII antibodies that inhibit or impair FVIII treatment comprising, detecting a haplotype in a FVIII gene in a subject, matching a replacement FVIII therapy to the detected haplotype, and administering the matched replacement FVIII therapy to the subject. The haplotype can be H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6).

Disclosed is a method of preventing the generation of anti-FYIII antibodies that inhibit or impair FVIII treatment comprising, detecting a haplotype in a FVIII gene in a subject, matching a replacement FVIII therapy to the detected haplotype, and administering the matched replacement FVIII therapy to the subject. The haplotype can be H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6).

Disclosed is a method of maximizing efficacy of transfusion therapy in a subject with a hemostatic disorder comprising, determining whether the FVIII haplotype of a subject having a hemostatic disorder is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6) and administering an appropriate transfusion product to the subject based on the results. The transfusion product can be a recombinant FVIII. The transfusion product can be plasma derived FVIII.

Disclosed is a method of administering a blood product to a subject in need of FVIII comprising, obtaining a haplotype in a FVIII gene of a blood product recipient, determining which type of blood product the recipient should receive, and administering to the subject in need thereof an appropriate blood product. The blood product can be pooled blood plasma derived from more than one blood donor. The blood product can be a plasma-derived FVIII preparation. The pooled blood plasma can be obtained by detecting a haplotype in a FVIII gene of a blood plasma donor and placing the blood plasma of the blood plasma donor in an appropriate FVIII haplotype pool based on the results.

Disclosed is a method of blood plasma pooling comprising, detecting a haplotype in a FVIII gene of a blood plasma donor and placing blood plasma of the blood plasma donor in an appropriate pool based on the results. Disclosed is a pooled blood plasma product obtained through this method.

Disclosed is a method of blood plasma pooling comprising, detecting a haplotype in a FVIII gene of a whole blood donor, receiving whole blood from the whole blood donor, separating plasma from the whole blood, and pooling the plasma with plasma obtained from other donors with the same where possible or most closely matched haplotype. Disclosed is a pooled blood plasma product obtained through this method.

Disclosed is a method of preparing a plasma-derived FVIII product comprising, determining the haplotype of blood plasma, wherein the haplotype is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6), and preparing a plasma-derived FVIII product from the haplotyped blood plasma wherein the resulting FVIII product is homogenous for single haplotype or enriched with selected haplotypes with respect to FVIII content. Disclosed is a plasma-derived FVIII product obtained through this method.

Disclosed is a method of treating a subject with a hemostatic disorder comprising, identifying a subject with a hemostatic disorder, determining the FVIII haplotype of the subject, wherein the haplotype is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6) and administering an appropriate FVIII gene replacement product to the subject based on the results. The hemostatic disorder can be congenital hemophilia A. The hemostatic disorder can be acquired hemophilia A.

Disclosed is a method of treating a subject with a hemostatic disorder comprising, identifying a subject with a hemostatic disorder, determining the FVIII haplotype of the subject, wherein the haplotype is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6) and administering an appropriate plasma-derived FVIII product to the subject based on the results. The hemostatic disorder can be congenital hemophilia A. The hemostatic disorder can be acquired hemophilia A.

Disclosed is a method of treating a subject with a hemostatic disorder comprising, identifying a subject with a hemostatic disorder, determining the FVIII haplotype of the subject, wherein the haplotype is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6) and administering an appropriate recombinant FVIII product to the subject based on the results. The hemostatic disorder can be congenital hemophilia A. The hemostatic disorder can be acquired hemophilia A.

Disclosed is a method for rapidly diagnosing a FVIII haplotype in a subject, comprising, obtaining a sample from the subject, analyzing the sample using rapid PCR, and determining a FVIII haplotype for the subject. The FVIII haplotype can be selected from the group consisting of H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6). The subject can be diagnosed with congenital hemophilia A. The subject can be diagnosed with acquired hemophilia A.

Disclosed is a method of maximizing the sensitivity and specificity of clinical diagnostic algorithms for identifying a subject with a prothrombotic hemostatic disorder comprising, obtaining a sample from the subject, determining whether the FVIII haplotype of a subject having a hemostatic disorder is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6) and performing the appropriate additional laboratory diagnostic testing on the subject based on the results.

Disclosed is a method of treating a subject with a prothrombotic hemostatic disorder comprising, identifying a subject with a hemostatic disorder, determining the FVIII haplotype of the subject, wherein the haplotype is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6) and administering an appropriate anti-thrombotic prophylactic treatment regimen to the subject based on the results.

Disclosed are antibodies that target high risk haplotypes of FVIII. Disclosed are antibodies that target peptide regions unique to said high risk haplotypes. Disclosed are agents that neutralize the activity of high risk haplotypes. An agent can be, for example, a monoclonal antibody. Disclosed is an antibody to a polypeptide comprising the sequence as set forth in SEQ ID NO: 19. Disclosed is an n antibody to a polypeptide comprising the sequence as set forth in SEQ ID NO: 20. Disclosed is an n antibody to a polypeptide comprising the sequence as set forth in SEQ ID NO: 21. Disclosed is an n antibody to a polypeptide comprising the sequence as set forth in SEQ ID NO: 22. Disclosed is an antibody to a polypeptide comprising the sequence as set forth in SEQ ID NO: 23. Disclosed is an antibody to a polypeptide comprising the sequence as set forth in SEQ ID NO: 24.

Disclosed is a method of treating a subject with a prothrombotic hemostatic disorder comprising, identifying a subject with a prothrombotic hemostatic disorder, determining the FVIII haplotype of the subject, wherein the haplotype is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6) and administering an appropriate anti-thrombotic prophylactic treatment regimen to the subject based on the results. The hemostatic disorder can be congenital hemophilia A. The hemostatic disorder can be acquired hemophilia A.

Disclosed is a method of treating a subject with a hemostatic disorder comprising, identifying a subject with a hemostatic disorder, determining the FVIII haplotype of the subject, wherein the haplotype is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6), and administering an appropriate recombinant FVIII product to the subject based on the results.

Disclosed is a method for rapidly diagnosing a FVIII haplotype in a subject, comprising, obtaining a sample from the subject, analyzing the sample using FVIII haplotype specific antibodies, and determining a FVIII haplotype for the subject. The haplotype can be selected from the group consisting of H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6). The subject can be diagnosed as having an increased risk for a thrombotic event.

Disclosed is a method of screening to determine the presence of alloantibodies of FVIII comprising, administering FVIII of a known haplotype wherein the haplotype is (SEQ ID NO: 1), H2 (SEQ ID NO: 2), H3 (SEQ ID NO: 3), H4 (SEQ ID NO: 4), H5 (SEQ ID NO: 5), H6 (SEQ ID NO: 6), and determining whether alloantibody binding occurs.

Disclosed is a method of in vitro screening to determine the presence of alloantibodies or autoantibodies of FVIII comprising, testing FVIII of a known haplotype wherein the haplotype is H1 (SEQ ID NO: 1), H2 (SEQ ID NO: 2), H3 (SEQ ID NO: 3), H4 (SEQ ID NO: 4), H5 (SEQ ID NO: 5), H6 (SEQ ID NO: 6), in a Bethesda Assay for determining the Bethesda Units as a measure of reactivity with alloantibodies.

Disclosed is an oligonucleotide comprising the sequence as set forth in SEQ ID NO: 1. Disclosed is an oligonucleotide comprising the sequence as set forth in SEQ ID NO: 2. Disclosed is an oligonucleotide comprising the sequence as set forth in SEQ ID NO: 3. Disclosed is an oligonucleotide comprising the sequence as set forth in SEQ ID NO: 4. Disclosed is an oligonucleotide comprising the sequence as set forth in SEQ ID NO: 5. Disclosed is an oligonucleotide comprising the sequence as set forth in SEQ ID NO: 6.

Disclosed is an oligonucleotide comprising a sequence selected from the group consisting of SEQ ID NO:1-12 and 25-124.

Disclosed is a mixture of primers comprising SEQ ID NOS: 25 and 26. Disclosed is a mixture of primers comprising SEQ ID NOS: 29 and 30. Disclosed is a mixture of primers comprising SEQ ID NOS: 33 and 34. Disclosed is a mixture of primers comprising SEQ ID NOS: 37 and 38. Disclosed is a mixture of primers comprising SEQ ID NOS: 25 and 26. Disclosed is a mixture of primers comprising SEQ ID NOS: 41 and 42. Disclosed is a mixture of primers comprising SEQ ID NOS: 43 and 44. Disclosed is a mixture of primers comprising SEQ ID NOS: 45 and 46. Disclosed is a mixture of primers comprising SEQ ID NOS: 47 and 48. Disclosed is a mixture of primers comprising SEQ ID NOS: 49-124.

Disclosed is a polypeptide comprising the sequence as set forth in SEQ ID NO: 13. Disclosed is a polypeptide comprising the sequence as set forth in SEQ ID NO: 14. Disclosed is a polypeptide comprising the sequence as set forth in SEQ ID NO: 15. Disclosed is a polypeptide comprising the sequence as set forth in SEQ ID NO: 16. Disclosed is a polypeptide comprising the sequence as set forth in SEQ ID NO: 17. Disclosed is a polypeptide comprising the sequence as set forth in SEQ ID NO: 18. Disclosed is a polypeptide comprising the sequence as set forth in SEQ ID NO: 19. Disclosed is a polypeptide comprising the sequence as set forth in SEQ ID NO: 20. Disclosed is a polypeptide comprising the sequence as set forth in SEQ ID NO: 21 Disclosed is a polypeptide comprising the sequence as set forth in SEQ ID NO: 22. Disclosed is a polypeptide comprising the sequence as set forth in SEQ ID NO: 23. Disclosed is a polypeptide comprising the sequence as set forth in SEQ ID NO: 24.

Disclosed is a composition comprising pooled FVIII having a single haplotype. The haplotype can be H1, H2, H3, H4, H5 or H6.

Disclosed is a recombinant FVIII having the H1 haplotype. Disclosed is a recombinant FVIII having the H2 haplotype. Disclosed is a recombinant FVIII having the H3 haplotype. Disclosed is a recombinant FVIII having the H4 haplotype. Disclosed is a recombinant FVIII having the H5 haplotype. Disclosed is a recombinant FVIII having the H6 haplotype.

BRIEF DESCRIPTION OF THE DRAWINGS

The accompanying drawings, which are incorporated in and constitute a part of this specification, illustrate several embodiments and together with the description illustrate the disclosed compositions and methods.

FIGS. 1A-1E are amplicon models for resequencing an FVIII gene to identify haplotype.

FIG. 3 is a schematic representation of seven wildtype FVIII proteins and the percentage of racial populations that express such haplotypes.

FIG. 5: FIGS. 5A-5C illustrate plasmids that can express five forms of FVIII.

DETAILED DESCRIPTION

Figure 1:
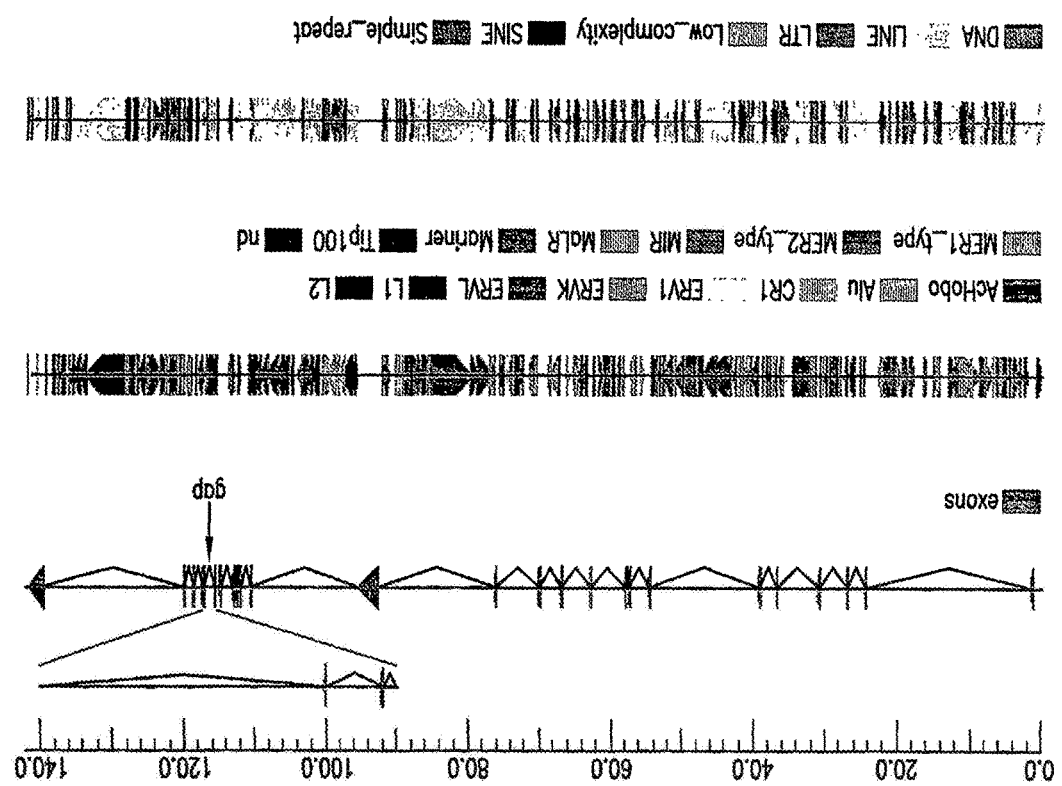
FIG. 1.

Before the present compounds, compositions, articles, devices, and/or methods are disclosed and described, it is to be understood that they are not limited to specific synthetic methods or specific recombinant biotechnology methods unless otherwise specified, or to particular reagents unless otherwise specified, as such may, of course, vary. It is also to be understood that the terminology used herein is for the purpose of describing particular embodiments only and is not intended to be limiting.

A. Definitions

As used in the specification and the appended claims, the singular forms "a," "an" and "the" include plural referents unless the context clearly dictates otherwise. Thus, for example, reference to "a pharmaceutical carrier" includes mixtures of two or more such carriers, and the like.

Ranges can be expressed herein as from "about" one particular value, and/or to "about" another particular value. When such a range is expressed, another embodiment includes from the one particular value and/or to the other particular value. Similarly, when values are expressed as approximations, by use of the antecedent "about," it will be understood that the particular value forms another embodiment. It will be further understood that the endpoints of each of the ranges are significant both in relation to the other endpoint, and independently of the other endpoint. It is also understood that there are a number of values disclosed herein, and that each value is also herein disclosed as "about" that particular value in addition to the value itself. For example, if the value "10" is disclosed, then "about 10" is also disclosed. It is also understood that when a value is disclosed that "less than or equal to" the value, "greater than or equal to the value" and possible ranges between values are also disclosed, as appropriately understood by the skilled artisan. For example, if the value "10" is disclosed the "less than or equal to 10" as well as "greater than or equal to 10" is also disclosed. It is also understood that the throughout the application, data is provided in a number of different formats, and that this data, represents endpoints and starting points, and ranges for any combination of the data points. For example, if a particular data point "10" and a particular data point 15 are disclosed, it is understood that greater than, greater than or equal to, less than, less than or equal to, and equal to 10 and 15 are considered disclosed as well as between 10 and 15. It is also understood that each unit between two particular units are also disclosed. For example, if 10 and 15 are disclosed, then 11, 12, 13, and 14 are also disclosed.

In this specification and in the claims which follow, reference will be made to a number of terms which shall be defined to have the following meanings:

"Optional" or "optionally" means that the subsequently described event or circumstance may or may not occur, and that the description includes instances where said event or circumstance occurs and instances where it does not.

"Probes" are molecules capable of interacting with a target nucleic acid, typically in a sequence specific manner, for example through hybridization. The hybridization of nucleic acids is well understood in the art and discussed herein. Typically a probe can be made from any combination of nucleotides or nucleotide derivatives or analogs available in the art.

"Primers" are a subset of probes which are capable of supporting some type of enzymatic manipulation and which can hybridize with a target nucleic acid such that the enzymatic manipulation can occur. A primer can be made from any combination of nucleotides or nucleotide derivatives or analogs available in the art which do not interfere with the enzymatic manipulation.

The terms "higher," "increases," "elevates," or "elevation" refer to increases above basal levels, e.g., as compared to a control. The terms "low," "lower," "reduces," or "reduction" refer to decreases below basal levels, e.g., as compared to a control. For example, basal levels are normal in vivo levels prior to, or in the absence of, treatment as disclosed herein.

As used throughout, by a "subject" is meant an individual. Thus, the "subject" can include domesticated animals, such as cats, dogs, etc., livestock (e.g., cattle, horses, pigs, sheep, goats, etc.), laboratory animals (e.g., mouse, rabbit, rat, guinea pig, etc.) and birds. Preferably, the subject is a mammal such as a primate, and, more preferably, a human.

Throughout this application, various publications are referenced. The disclosures of these publications in their entireties are hereby incorporated by reference into this application in order to more fully describe the state of the art to which this pertains. The references disclosed are also individually and specifically incorporated by reference herein for the material contained in them that is discussed in the sentence in which the reference is relied upon.

B. General

The present invention may be understood more readily by reference to the following detailed description of preferred embodiments of the invention and the Examples included therein and to the Figures and their previous and following description.

Blood clotting begins when platelets adhere to the cut wall of an injured blood vessel at a lesion site. Subsequently, in a cascade of enzymatically regulated reactions, soluble fibrinogen molecules are converted by the enzyme thrombin to insoluble strands of fibrin that hold the platelets together in a thrombus. At each step in the cascade, a protein precursor is converted to a protease that cleaves the next protein precursor in the series. Co-factors are required at most of the steps. Factor VIII circulates as an inactive precursor in blood, bound tightly and non-covalently to von Willebrand factor. Factor VIII is proteolytically activated by thrombin or factor Xa, which dissociates it from von Willebrand factor and activates its procoagulant function in the cascade. In its active form, the protein factor VIIIa is a cofactor that increases the catalytic efficiency of factor IXa toward factor X activation by several orders of magnitude.

People with deficiencies in factor VIII or antibodies against factor VIII who are not treated with factor VIII suffer uncontrolled internal bleeding that may cause a range of serious symptoms, from inflammatory reactions in joints to early death. Severe hemophiliacs, who number about 10,000 in the United States, can be treated with infusion of human factor VIII, which will restore the blood's normal clotting ability if administered with sufficient frequency and concentration. The classical definition of factor VIII is that substance present in normal blood plasma that corrects the clotting defect in plasma derived from individuals with hemophilia A.

The development of factor VIII (FVIII) inhibitors has been, next to HIV and hepatitis, the most serious complication of hemophilia therapy. Although the recent production of highly purified and genetically engineered FVIII products has decreased the risk of these infections, the development of inhibitors remains a major therapeutic challenge. Because affected patients, usually children, are rendered resistant to conventional replacement therapy, control of hemostasis becomes difficult, resulting in substantial morbidity.

Inhibitors (alloantibodies) are IgG antibodies, mostly of the IgG4 subclass, that react with FVIII and interfere with its pro-coagulant function. Clinically, patients with inhibitors are classified into high and low responders according to the strength of the anamnestic response they experience when they are re-exposed to FVIII. The goals of therapy in these patients are to control severe acute bleeding and to eradicate the inhibitor.

Two so called by passing agents are used to control bleeding in hemophilia A patients refractory to fVIII. FEIBA, an acronym for "factor eight inhibitor bypassing activity" is derived from large pools of human plasma and is comprised of activated coagulation factors prothrombin, factors VIII, IX and X. Considerable care and experience is required to use FEIBA safely. It has been associated with thromboembolic events in patients, notably disseminated intravascular coagulation with mortality and at least 14 reported cases of myocardial infarcts. NovoSeven is a recombinant form of activated coagulation factor VIII (rfVIII). The product is safe and for most but not all hemophilia A patients effective in controlling bleeds. A drawback of using any bypassing agent, including Novo-Seven, is the absence of reliable quantitative assays to monitor activity level. In contrast, FVIII levels and activity may be readily determined and treatment adjusted accordingly. Perhaps the major disadvantage of NovoSeven is its costs. It has a very short half-life which necessitates multiple intravenous infusions. Use of NovoSeven to cover surgery may cost hundreds of thousands of dollars per procedure. A third product designed to treat inhibitor patients, recombinant porcine fVIII, is in phase 2 clinical trials (octagen.com) and not yet commercially available. Attempts have been made to ascertain the costs of treating high titer inhibitor patients, especially in comparison to those having no, or low titer. In one study of treatment costs for 104 hemophilia patients at Centre Hospitalier Regional Iniversitaire, Lille, France, it was determined that over the period 1988-1995 average annual costs for treatment were $41,000 for patients having no inhibitors, $46,000 for those having low responding inhibitors and $59,000 for those with high responding inhibitors (Goudemand, J 1998).

Another strategy for coping with inhibitors is to attempt to induce immune tolerance (ITT) to FVIII. ITI involves frequent exposure to FVIII over extended periods of time and is not always successful. In one protocol high purity factor was given at a dose of 100 IU FVIII/kg body weight per day for 8-18 months Rocino et, al 1999). The Bonn protocol requires high doses of FVIII twice daily (Kreuz et. al., 2003). The large amounts of factor needed for successful ITI render it cost prohibitive in many circumstances The pathogenesis of inhibitor development is complex and poorly understood. The nature of the hemophilic mutation is one risk factor for inhibitor development. Patients with large gene deletions, nonsense mutations and intrachromosomal aberrations have a higher incidence of inhibitors than those with missense mutations, small deletions/insertions and splice site mutations. This risk variability is thought to reflect the degree of tolerance that the patient has for the infused replacement product. A weak correlation has also been shown between risk of inhibitor development and major histocompatibility complex (MHC) class I/II genotypes. However, none of these relationships is inviolate in that some patients with high risk mutations and unfavorable genotypes do not develop inhibitors, while others with missense mutations do.

Ethnicity is also a well established risk determinant for inhibitors. The incidence of inhibitors among African-American (AA) hemophilia patients is twice that observed in Caucasians. No clear explanation of the basis for this elevated risk has emerged. Recently, we sequenced the F8 from 137 healthy people representing seven ethnic groups and identified four common nonsynonymous single nucleotide polymorphisms (nsSNPs). We further found that naturally-occuring haplotypes of these nsSNPs encode six structurally-distinct wildtype FVIII proteins. Five of these haplotypes, designated H1, H2, H3, H4 & H5, are expressed by African-Americans, whereas only two, H1 & H2, are expressed by Caucasians. Two haplotypes, H3 & H5, which together are expressed in ~23% of African-Americans, have the minor allele of M2238V in the C2 dominant epitope.

Figure 2:
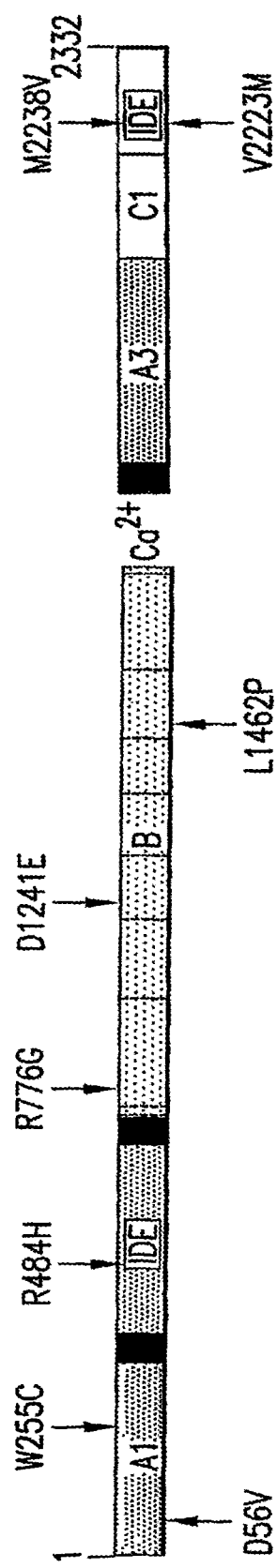
FIG. 2 is a schematic representation of non-synonymous single nucleotide polymorphisms (SNP's) of the human coagulation FVIII protein.
Figure 4:
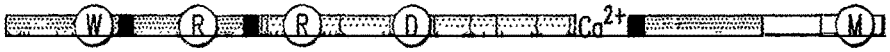
FIG. 4 is a schematic representation of three commercially available forms of wildtype FVIII.

Loss-of-function mutations in the gene encoding factor FVIII represent the inherited basis for hemophilia (H)A. Currently, HA is treated primarily through exogenous factor replacement therapy using either recombinant (r)- or plasma-derived (pd)-FVIII. There are currently three commercially available concentrated r-FVIII preparations that are in current use for treating HA patients (FIG. 4). As shown in FIG. 4, the H1 and H2 haplotypes are represented by commercially available FVIII. While FVIII has previously been thought to be a monomorphic protein in the non-hemophilic population, the present invention provides at least four common non-synonymous-single-nucleotide-polymorphisms (nsSNPs), combinations of which represent six naturally-occurring allelic variants of the FVIII protein in the human population (FIG. 2). In FIG. 2, the five SNP's (W255C, R484H, R776G, D1241E, and M2238V) are illustrated. Combinations of these four SNP's correspond to six haplotypes. This has been determined by direct DNA sequencing of PCR amplified fragments of the FVIII genes from numerous unrelated individuals of multiple ethnicities; FIG. 1 shows a description of an nsSNP genotyping assay which is based on DNA sequencing. PCR can generate 35 amplicons which are subsequently subjected to automated DNA sequencing. By examining male members of different ethnic groups (e.g. because they only have one X-Chromosome) and females who are homozygous for all nsSNPs or are only singly heterozygous, the naturally-occurring haplotypes (H) of these variations have been defined (e.g. the combinations by which the alleles of these five nsSNPs segregate naturally). As such, six different haplotypic forms of the wt FVIII protein have been identified. These haplotypic forms have been designated: H1 (SEQ ID NO: 1), H2

(SEQ ID NO: 2), H3 (SEQ ID NO: 3), H4 (SEQ ID NO: 4), H5 (SEQ ID NO: 5), and H6 (SEQ ID NO: 6) (FIG. 3). Each of these variants represents a normal allelic variant of the FVIII protein since the individuals from whom the sequences were described have no bleeding disorders.

Based upon these allelic or haplotypic variants, a specific genetic test has been designed to establish the fVIII genotype of any individual (FIG. 1 shows a description of a SNP assay). In addition, the plasmid-based FVIII expression vectors for expressing the different haplotypes (e.g. each of these variants) have been developed using recombinant technology (FIG. 5). Thus, novel alleles can be identified, cloned into expression vectors, and a screening test developed to determine the genotype of a given individual. This allows for the determination of any subject's allelic type and correct allelic matching of the replacement FVIII product.

One of the main problems that arise during FVIII replacement therapy is that the hemophilic recipient often mounts an alloimmune response against the recombinant FVIII protein that is infused. This occurs because wild type FVIII represents a foreign protein and is thus not recognized as self by the immune system. In the past, it has been assumed that this immune response is directed against the wild type sequence(s) that is or are absent in the hemophilic patient due to the pathogenic mutation. However, any subject who has a hemophilic mutation on the background of a different naturally occurring allele than the recombinant factor can also mount an immune response against the naturally occurring variation(s).

An advantage of the present invention is that matching the replacement product to the background allele of the recipient can minimize the immunological barriers involved in FVIII replacement. In this way, the only difference is the pathogenic mutation itself. Consequently, the efficacy of FVIII replacement therapy can be maximized and the likelihood of developing potentially fatal antibody-based inhibitors can be significantly reduced. This is a clear advantage to the current technology, which is limited by the fact that only two allelic variant of recombinant FVIII is available. Similarly, plasma derived products are expected to be highly enriched with haplotypes most common in the plasma or blood donor population from which the replacement factor is processed. In the US plasma derived preparations of NM would be expected to be somewhat heterogenous with respect to fVIII haplotype content but highly enriched for H1. Thus, the present invention allows expression of different recombinant FVIII alleles or the use of the existing recombinant or plasma derived allelic variants to treat matched subjects. By matching these alleles to the background allele of the hemophilic subject, the problem of the generation of antibodies that inhibit successful treatment of hemophilia with recombinant FVIII may be reduced or eliminated.

The relevancy of this approach is not limited to replacement transfusion therapy of hemophilia A patients with congenital deficiencies of FVIII. There are other known hereditary bleeding disorders resulting from congenital deficiencies or functional defects in von Willebrand's factor and coagulation factors IX (FIX) and XI (FXI). Since antibody inhibitors against these proteins are known complications of factor replacement therapy, the disclosed invention is generally applicable to maximizing transfusion efficacy in the treatment of these other hemostatic disorders.

In addition to the problems inherent to congenital hemostatic disorders, this general approach has broad relevancy to treatment of acquired bleeding diathesis. Transfusion of fresh frozen plasma (FFP) is often used in the treatment of bleeding patients with multiple coagulation derangements, such as individuals in liver failure who have decreased synthesis of all coagulation factors except FVIII. Since there are likely to be naturally occurring allelic variants of these other coagulation factors, analogous to the alleles off FVIII and FIX, such subjects can respond by producing inhibitory antibodies reactive against each allelic variant not encoded by their own genome. Thus, in the multiply transfused subject, the efficacy of plasma products can significantly decline as immunity arises. In contrast to the situation for cellular transfusion therapy, there is no current methodology for matching plasma donor products to the genotype or haplotype of a recipient. The assay systems disclosed herein, however, allow genotyping of plasma donors and recipients. By matching plasma products to the subjects receiving them, as is already done with blood cells, the production of antibody-based coagulation inhibitors is avoided. This can drastically improve efficacy in the treatment of acquired bleeding disorders.

Since gene replacement is another approach for factor replacement in hemophilia A and other heritable bleeding diatheses, matching the expressed coagulation factor with the recipient allele is of utmost importance at the DNA level for designing various recombinant expression vectors. The series of different FVIII constructs disclosed, which represent all naturally occurring haplotypic alleles, allow each hemophiliac undergoing gene therapy to receive allelically matched replacement FVIII protein. Therefore, this approach can reduce or prevent the induction of immune responses to the protein whether the exposure occurs by replacement therapy or gone therapy. This is important because such a response in the gene therapy setting can result in both neutralizing antibodies against the protein and lytic responses against host tissues that are successfully transduced with the gene therapy vector. Preventing such a response is an essential requirement for the success of any gene therapy approach regardless of which molecular or cellular vehicle is ultimately found to be the optimal vector for transgene delivery.

Autoantibodies occurring in subjects with acquired hemophilia A differ in many aspects from alloantibodies developing in subjects with congenital hemophilia A after replacement therapy. Like the alloantibodies occurring in severe hemophilia A, factor VIII inhibitors have been characterized as being predominantly polyclonal, belonging to an IgG4 subclass. However, in contrast to the situation in congenital hemophilia, monoclonal IgA or IgM antibodies have also been described in subjects with acquired hemophilia A associated with hematologic malignancies. Another difference between FVIII autoantibodies and alloantibodies lies in their method of inhibition. The differences are, however, subtle, as autoantibody inhibitors are mainly directed against single epitopes on the factor VIII molecule (A2 domain, A3 domain, and, more frequently, C2 domain), whereas alloantibodies are usually directed against both the A2 and C2 domains and sometimes against the A3 domain.

Epitopes that are immunoreactive with antibodies that inhibit the coagulant activity of factor VIII have been characterized based on known structure-function relationships in factor VIII Inhibitors can, for example, act by disrupting any of the macromolecular interactions associated with the domain structure of factor VIII or its associations with von Willebrand factor, thrombin, factor Xa, factor IXa, or factor X. However, most inhibitory antibodies to human factor VIII act by binding to epitopes located in the 40 kDa A2 domain or 20 kDa C2 domain of factor VIII, disrupting specific functions associated with these domains, as described by Fulcher et al. (1985) Proc. Natl. Acad. Sci.

USA 82:7728-7732; and Scandella et al. (1988) Proc. Natl. Acad. Sci. USA 85:6152-6156 (herein incorporated by reference in their entirety). In addition to the A2 and C2 epitopes, there may be a third epitope in the A3 or C1 domain of the light chain of factor VIII, according to Scandella et al. (1993) Blood 82:1767-1775. The significance of this putative third epitope is unknown, but it appears to account for a minor fraction of the epitope reactivity in factor VIII.

Anti-A2 antibodies block factor X activation, as shown by Lollar et al. (1994) J. Clin. Invest. 93:2497-2504 (incorporated by reference in their entirety). Previous mapping studies by deletion mutagenesis described by Ware et al. (1992) Blood Coagul. Fibrinolysis 3:703-716, incorporated by reference in their entirety, located the A2 epitope to within a 20 kDa region of the NH.sub.2-terminal end of the 40 kDa A2 domain. Competition immunoradiometric assays have indicated that A2 inhibitors recognize either a common epitope or narrowly clustered epitopes, as described by Scandella et al. (1992) Throm. Haemostas. 67:665-671, and as demonstrated in U.S. Pat. No. 5,859,204 (both herein incorporated by reference in their entirety).

In this application the term low, reduced, or nonantigenic FVIII is used to describe a FVIII construct that does not demonstrate reduced coagulant activity in vitro when exposed to potentially antibodies or in vivo when administrated to a patient that has deficient FVIII coagulant activity. The patient may have congenital or acquired hemophilia A.

In this application the term low, reduced or nonimmunogenic FVIII is used to describe a FVIII construct that when administered to previously untreated congenital hemophilia A patients does not stimulate the formation of antibodies that react with such fVIII construct or stimulates the formation of antibodies that react with such factor in a less effective manner or in a mariner that does not reduce the clinical efficacy of the administered factor to the same degree as other replacement fVIII do.

Testing of Recombinant Factor VIII Molecules: Factor VIII replacement molecules that are haplotypically matched to the patient haplotype (haplotypically matched fVIII) can be tested in humans for their reduced antigenicity and/or immunogenicity in at least two types of clinical trials. In one type of trial, designed to determine whether haplotypically matched factor VIII is immunoreactive with inhibitory antibodies haplotypically matched factor VIII s administered, preferably by intravenous infusion, to approximately 25 patients having factor VIII deficiency who have antibodies to factor VIII that inhibit the coagulant activity of therapeutic human FVH that is not haplotypically matched. The dosage of haplotypically matched fVIII is in a range between 5 and 50 Units/kg body weight, preferably 10-50 Units/kg, and most preferably 40 Units/kg body weight. Approximately 1 hour after each administration, the recovery of factor VIII from blood samples is measured in a one-stage coagulation assay. Samples are taken again approximately 5 hours after infusion, and recovery is measured. Total recovery and the rate of disappearance of factor VIII from the samples is predictive of the antibody titer and inhibitory activity. If the antibody titer is high, factor VIII recovery usually cannot be measured. The recovery results of the haplotypically matched fVIII are compared to the recovery of recovery results for factor VIII, that is not haplotypically matched porcine factor VIII, and other commonly used therapeutic forms of factor VIII or factor VIII substitutes.

In a second type of clinical trial, designed to determine whether the haplotypically matched fVIII is immunogenic, i.e., whether patients will develop inhibitory antibodies that react with the haplotypically matched fVIII, haplotypically matched fVIII, is administered, as described in the preceding paragraph, to approximately 100 previously untreated hemophiliac patients who have not developed antibodies to factor VIII. Treatments are given approximately every 2 weeks over a period of 6 months to 1 year. At 1 to 3 month intervals during this period, blood samples are drawn and Bethesda assays or other antibody assays are performed to determine the presence of inhibitory antibodies. Recovery assays can also be done, as described above, after each infusion. Results are compared to hemophiliac patients who receive human factor VIII that is not haplotypically matched or to porcine factor VIII, or other commonly used therapeutic forms of factor VIII or factor VIII substitutes.

Anti-FVIII antibodies (Ab) include three subtypes analogous to RBC antigens (Ag) and Ab. The three subtypes include:

Isoantibodies→the subtype of anti-FVIII Ab that occurs in hemophilia A patients who have no immunologically detectable circulating FVIII protein. This type of FVIII-deficiency is referred to as cross-reactive-material-negative (CRM−), and is due to the presence of a F8 mutation subtype known as a null-mutation, which include the following: large deletions, nonsense mutations and intragenic inversions, such as the recurrent intron 22 inversion, or, less frequently, the intron 1 inversion.

Alloantibodies→the subtype of anti-FVIII Ab that occurs in hemophilia A patients who have have an immunologically detectable circulating FVIII protein that is dysfunctional. This type of FVIII-deficiency is referred to as either CRM-positive (CRM+) or CRM-reduced (CRM-r), and is typically found in patients who have a hemophilic missense F8 mutation. Hemophilia A patients with certain small deletions and/or splice-site mutations can also have CRM+ or CRM-r FVIII-deficiencies.

Autoantibodies→the subtype of anti-FVIII Ab that occurs in non-hemophilic individuals with wildtype FVIII who develop acquired hemophilia A.

These anti-FVIII antibodies bind and inhibit the function of FVIII (i.e. the catalytically inactive form of the molecule referred to as the pro-cofactor form) and/or FVIIIa (i.e. the catalytically active form of the molecule referred to as the cofactor form), both in vivo and in clotting assays in vitro. The antibodies are usually IgG (primarily IgG4) and bind limited regions of FVIII. A subset of the anti-FVIII Ab that develop can increase peripheral clearance and/or degradation of F VIII.

While several effective pharmacologic agents are already available to clinicians for use in both treating and prophylaxing against thrombosis, physicians are not able to accurately identify those individuals at greatest risk for these disorders. Since strokes and heart attacks are just two facets of thrombosis, many more people will suffer from this disorder than are affected by hemophilia A, or from all congenital bleeding disorders combined. Disclosed are diagnostic algorithms, which accurately identify at risk individuals and allow prophylactic risk reduction regimens to be implemented prior to their manifesting a stroke or heart attack, or other types cardiovascular thrombosis. The alleles of the four ns-SNPs, which underlie the 6 naturally-occurring forms of the FVIII protein in humans, are functionally distinct and may influence the circulating level of FVIII. With respect to the D1241E ns-SNP, for example, those with the E-allele at the protein level (or G-allele at the nucleotide level), have about a 25% lower mean circulating FVIII level. Since elevated circulating levels of this coagulation protein a frequently observed phenotype in the non-hemophilic population, have been associated with elevated risk for both arterial and venous thrombosis, the E-allele of D1241E may be protective against thrombosis. Therefore, the methods disclosed for differentiating between the alleles of, for example, the D1241E ns-SNP, or, within the set of six naturally-occurring haplotypes of the FVII1 protein, the subset that contains the E-allele of this ns-SNP (i.e. H2, H3, H4, and H6) and the subset that contains the D-allele (i.e. H1 and H5) improve current diagnostic algorithms for assessing thrombosis risk. This type of testing, in contrast to the rapid testing described herein for the hemophilia, is largely for diagnosis risk assessment, in order to guide prophylactic treatment decisions, as such does not necessarily have to be performed in a rapid manner.

The present invention is described with regards to Hemophilia as well as other hemostatic disorders including: afibrinogenemia, dysfibrinogenemia, nonplatelet hemostasis, coagulation, thrombosis, thrombophilia, FV deficiency, Owren disease, parahemophilia, FVII deficiency, FVIII deficiency, FX deficiency, FXI deficiency, FXII deficiency, FXIII deficiency, factor V Leiden deficiency, DIC, protein C deficiency, activated protein C resistance, protein S deficiency, antithrombin III deficiency, hypoprothrombinemias, cryoglobulinemias, multiple myeloma, Waldenstrom macroglobulinemia, Henoch-Schönlein purpura, hyperglobulinemic purpura, cavernous hemangioma, hereditary hemorrhagic telangiectasia, pseudoxanthoma elasticum, Ehlers-Danlos syndrome, Cushing syndrome, Shwartzman phenomenon, von Willebrand disease, Waterhouse-Friderichsen syndrome, and Wiskott-Aldrich syndrome.

Thus, disclosed herein are methods and compositions relating to the various haplotypes of FVBI, and how they can be used advantageously to treat subjects with diseases and disorders relating to FVIII.

C. Compositions

Disclosed are the components to be used to prepare the disclosed compositions as well as the compositions themselves to be used within the methods disclosed herein. For example, disclosed herein are various haplotypes of FVIII, each with a different sequence identity. These haplotypes and variations and combinations of these haplotypes are contemplated. It should be noted that the specific haplotypes disclosed herein need not be varied, and their specific sequences are important with many of the methods disclosed herein. However, where variations can occur, and where such variations are useful, the following principles regarding homology and sequence variation apply. Therefore, it is understood that when combinations, subsets, interactions, groups, etc. of these materials are disclosed that while specific reference of each various individual and collective combinations and permutation of these compounds may not be explicitly disclosed, each is specifically contemplated and described herein, wherein such may apply. For example, if a particular haplotype is disclosed and discussed and a number of modifications that can be made to a number of molecules including the point of interest of the haplotype are discussed, specifically contemplated is each and every combination and permutation of the haplotype and the modifications that are possible unless specifically indicated to the contrary. Thus, if a class of molecules A, B, and C are disclosed as well as a class of molecules D, E, and F and an example of a combination molecule, A-D is disclosed, then even if each is not individually recited each is individually and collectively contemplated meaning combinations, A-E, A-F, B-D, B-E, B-F, C-D, C-E, and C-F are considered disclosed. Likewise, any subset or combination of these is also disclosed. Thus, for example, the sub-group of A-E, B-F, and C-E would be considered disclosed. This concept applies to all aspects of this application including, but not limited to, steps in methods of making and using the disclosed compositions. Thus, if there are a variety of additional steps that can be performed it is understood that each of these additional steps can be performed with any specific embodiment or combination of embodiments of the disclosed methods.

1. Sequence Similarities

It is understood that as discussed herein the use of the terms homology and identity mean the same thing as similarity. Thus, for example, if the use of the word homology is used between two non-natural sequences it is understood that this is not necessarily indicating an evolutionary relationship between these two sequences, but rather is looking at the similarity or relatedness between their nucleic acid sequences. Many of the methods for determining homology between two evolutionarily related molecules are routinely applied to any two or more nucleic acids or proteins for the purpose of measuring sequence similarity regardless of whether they are evolutionarily related or not.

In general, it is understood that one way to define any known variants and derivatives or those that might arise, of the disclosed genes and proteins herein, is through defining the variants and derivatives in terms of homology to specific known sequences. This identity of particular sequences disclosed herein is also discussed elsewhere herein. In general, variants of genes and proteins herein disclosed typically can have at least, about 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99 percent homology to the stated sequence or the native sequence. This principle can apply to primers, probes, and other nucleic acids and proteins as described herein. However, in certain instances as disclosed herein, genetic variants have defined sequence differences which may not have a given percentage of change, but may instead have 1, 2, 3, 4, 5, 6, 7, 8, 9, 10, or more differences in nucleic acid or amino acid sequence when compared to a native, known, or control sequence. Those of skill in the art readily understand how to determine the homology of two proteins or nucleic acids, such as genes. For example, the homology can be calculated after aligning the two sequences so that the homology is at its highest level.

Another way of calculating homology can be performed by published algorithms Optimal alignment of sequences for comparison may be conducted by the local homology algorithm of Smith and Waterman Adv. Appl. Math. 2: 482 (1981), by the homology alignment algorithm of Needleman and Wunsch, J. MoL Biol. 48: 443 (1970), by the search for similarity method of Pearson and Lipman, Proc. Natl. Acad. Sci. U.S.A. 85: 2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by inspection.

The same types of homology can be obtained for nucleic acids by for example the algorithms disclosed in Zuker, M. Science 244:48-52, 1989, Jaeger et al. Proc. Natl. Acad. Sci. USA 86:7706-7710, 1989, Jaeger et al. Methods Enzynzol. 183:281-306, 1989 which are herein incorporated by reference for at least material related to nucleic acid alignment. It is understood that any of the methods typically can be used and that in certain instances the results of these various methods may differ, but the skilled artisan understands if identity is found with at least one of these methods, the sequences would be said to have the stated identity, and be disclosed herein.

For example, as used herein, a sequence recited as having a particular percent homology to another sequence refers to sequences that have the recited homology as calculated by any one or more of the calculation methods described above. For example, a first sequence has 80 percent homology, as defined herein, to a second sequence if the first sequence is calculated to have 80 percent homology to the second sequence using the Zuker calculation method even if the first sequence does not have 80 percent homology to the second sequence as calculated by any of the other calculation methods. As another example, a first sequence has 80 percent homology, as defined herein, to a second sequence if the first sequence is calculated to have 80 percent homology to the second sequence using both the Zuker calculation method and the Pearson and Lipman calculation method even if the first sequence does not have 80 percent homology to the second sequence as calculated by the Smith and Waterman calculation method, the Needleman and Wunsch calculation method, the Jaeger calculation methods, or any of the other calculation methods. As yet another example, a first sequence has 80 percent homology, as defined herein, to a second sequence if the first sequence is calculated to have 80 percent homology to the second sequence using each of calculation methods (although, in practice, the different calculation methods will often result in different calculated homology percentages).

2. Hybridization/Selective Hybridization

The term hybridization typically means a sequence driven interaction between at least two nucleic acid molecules, such as a primer or a probe and a gene. Sequence driven interaction means an interaction that occurs between two nucleotides or nucleotide analogs or nucleotide derivatives in a nucleotide specific manner For example, G interacting with C or A interacting with T are sequence driven interactions. Typically sequence driven interactions occur on the Watson-Crick face or Hoogsteen face of the nucleotide. The hybridization of two nucleic acids is affected by a number of conditions and parameters known to those of skill in the art. For example, the salt concentrations, pH, and temperature of the reaction all affect whether two nucleic acid molecules will hybridize.

Parameters for selective hybridization between two nucleic acid molecules are well known to those of skill in the art. For example, in some embodiments selective hybridization conditions can be defined as stringent hybridization conditions. For example, stringency of hybridization is controlled by both temperature and salt concentration of either or both of the hybridization and washing steps. For example, the conditions of hybridization to achieve selective hybridization may involve hybridization in high ionic strength solution (6× SSC or 6× SSPE) at a temperature that is about 12-25° C. below the Tm (the melting temperature at which half of the molecules dissociate from their hybridization partners) followed by washing at a combination of temperature and salt concentration chosen so that the washing temperature is about 5° C. to 20° C. below the Tm. The temperature and salt conditions are readily determined empirically in preliminary experiments in which samples of reference DNA immobilized on filters are hybridized to a labeled nucleic acid of interest and then washed under conditions of different stringencies. Hybridization temperatures are typically higher for DNA-RNA and RNA-RNA hybridizations. The conditions can be used as described above to achieve stringency, or as is known in the art. (Sambrook et al., Molecular Cloning: A Laboratory Manual, 2nd Ed., Cold Spring Harbor Laboratory, Cold Spring Harbor, N.Y., 1989; Kunkel et al. Methods Enzymol. 1987:154: 367, 1987 which is herein incorporated by reference for material at least related to hybridization of nucleic acids). A preferable stringent hybridization condition for a DNA: DNA hybridization can be at about 68° C. (in aqueous solution) in 6× SSC or 6× SSPE followed by washing at 68° C. Stringency of hybridization and washing, if desired, can be reduced accordingly as the degree of complementarity desired is decreased, and further, depending upon the G-C or A-T richness of any area wherein variability is searched for. Likewise, stringency of hybridization and washing, if desired, can be increased accordingly as homology desired is increased, and further, depending upon the G-C or A-T richness of any area wherein high homology is desired, all as known in the art.

Another way to define selective hybridization is by looking at the amount (percentage) of one of the nucleic acids bound to the other nucleic acid. For example, in some embodiments selective hybridization conditions would be when at least about, 60, 65, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 percent of the limiting nucleic acid is bound to the non-limiting nucleic acid. Typically, the non-limiting primer is in for example, 10 or 100 or 1000 fold excess. This type of assay can be performed at under conditions where both the limiting and non-limiting primer are for example, 10 fold or 100 fold or 1000 fold below their $k_d$, or where only one of the nucleic acid molecules is 10 fold or 100 fold or 1000 fold or where one or both nucleic acid molecules are above their $k_d$.

Another way to define selective hybridization is by looking at the percentage of primer that gets enzymatically manipulated under conditions where hybridization is required to promote the desired enzymatic manipulation. For example, in some embodiments selective hybridization conditions would be when at least about, 60, 65, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 percent of the primer is enzymatically manipulated under conditions which promote the enzymatic manipulation, for example if the enzymatic manipulation is DNA extension, then selective hybridization conditions would be when at least about 60, 65, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 percent of the primer molecules are extended. Preferred conditions also include those suggested by the manufacturer or indicated in the art as being appropriate for the enzyme performing the manipulation.

Just as with homology, it is understood that there are a variety of methods herein disclosed for determining the level of hybridization between two nucleic acid molecules. It is understood that these methods and conditions may provide different percentages of hybridization between two nucleic acid molecules, but unless otherwise indicated meeting the parameters of any of the methods would be sufficient. For example if 80% hybridization was required and as long as hybridization occurs within the required parameters in any one of these methods it is considered disclosed herein.

It is understood that those of skill in the art understand that if a composition or method meets any one of these criteria for determining hybridization either collectively or singly it is a composition or method that is disclosed herein.

3. Nucleic Acids

There are a variety of molecules disclosed herein that are nucleic acid based, including for example the nucleic acids that encode, for example FVIII, as well as various functional nucleic acids. The disclosed nucleic acids are made up of for example, nucleotides, nucleotide analogs, or nucleotide substitutes. Non-limiting examples of these and other molecules are discussed herein. It is understood that, for example, when a vector is expressed in a cell, the expressed mRNA will typically be made up of A, C, G, and U. Likewise, it is understood that if, for example, an antisense molecule is introduced into a cell or cell environment through for example exogenous delivery, it is advantagous that the antisense molecule be made up of nucleotide analogs that reduce the degradation of the antisense molecule in the cellular environment.

a) Nucleotides and Related Molecules

A nucleotide is a molecule that contains a base moiety, a sugar moiety and a phosphate moiety. Nucleotides can be linked together through their phosphate moieties and sugar moieties creating an internucleoside linkage. The base moiety of a nucleotide can be adenin-9-yl (A), cytosin-1-yl (C), guanin-9-yl (G), uracil-1-yl (U), and thymin-1-yl (T). The sugar moiety of a nucleotide is a ribose or a deoxyribose. The phosphate moiety of a nucleotide is pentavalent phosphate. An non-limiting example of a nucleotide would be 3'-AMP (3'-adenosine monophosphate) or 5'-GMP (5'-guanosine monophosphate).

A nucleotide analog is a nucleotide which contains some type of modification to either the base, sugar, or phosphate moieties. Modifications to the base moiety would include natural and synthetic modifications of A, C, G, and T/U as well as different purine or pyrimidine bases, such as uracil-5-yl (.psi.), hypoxanthin-9-yl (I), and 2-aminoadenin-9-yl. A modified base includes but is not limited to 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Additional base modifications can be found for example in U.S. Pat. No. 3,687,808, Englisch et al., Angewandte Chemie, International Edition, 1991, 30, 613, and Sanghvi, Y. S., Chapter 15, Antisense Research and Applications, pages 289-302, Crooke, S. T. and Lebleu, B. ed., CRC Press, 1993. Certain nucleotide analogs, such as 5-substituted pyrimidines, 6-azapyrimidines and N-2, N-6 and O-6 substituted purines, including 2-aminopropyladenine, 5-propynyluracil and 5-propynylcytosine. 5-methylcytosine can increase the stability of duplex formation. Often time base modifications can be combined with for example a sugar modifcation, such as 2'-O-methoxyethyl, to achieve unique properties such as increased duplex stability. There are numerous United States patents such as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; and 5,681,941, which detail and describe a range of base modifications. Each of these patents is herein incorporated by reference.

Nucleotide analogs can also include modifications of the sugar moiety. Modifications to the sugar moiety would include natural modifications of the ribose and deoxy ribose as well as synthetic modifications. Sugar modifications include but are not limited to the following modifications at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted $C_1$ to $C_{10}$, alkyl or $C_2$ to $C_{10}$ alkenyl and alkynyl. 2' sugar modiifcations also include but are not limited to —O[$(CH_2)_n$, O]$_m CH_3$, —O$(CH_2)_n OCH_3$, —O$(CH_2)_n NH_2$, —O$(CH_2)_n CH_3$, —O$(CH_2)_n$—$ONH_2$, and —O$(CH_2)_n$ON [$(CH_2)$, $CH_3)]_2$, where n and m are from 1 to about 10.

Other modifications at the 2' position include but are not limted to: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars would also include those that contain modifications at the bridging ring oxygen, such as $CH_2$ and S. Nucleotide sugar analogs may also have sugar mimetics such as cyclobutyl moieties in place of the pentofuranosyl sugar. There are numerous United States patents that teach the preparation of such modified sugar structures such as U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, each of which is herein incorporated by reference in its entirety.

Nucleotide analogs can also be modified at the phosphate moiety. Modified phosphate moieties include but are not limited to those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. It is understood that these phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts and free acid forms are also included. Numerous United States patents teach how to make and use nucleotides containing modified phosphates and include but are not limited to, U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050, each of which is herein incorporated by reference.

It is understood that nucleotide analogs need only contain a single modification, but may also contain multiple modifications within one of the moieties or between different moieties.

Nucleotide substitutes are molecules having similar functional properties to nucleotides, but which do not contain a phosphate moiety, such as peptide nucleic acid (PNA). Nucleotide substitutes are molecules that will recognize nucleic acids in a Watson-Crick or Hoogsteen manner, but which are linked together through a moiety other than a phosphate moiety. Nucleotide substitutes are able to conform to a double helix type structure when interacting with the appropriate target nucleic acid.

Nucleotide substitutes are nucleotides or nucleotide analogs that have had the phosphate moiety and/or sugar moieties replaced. Nucleotide substitutes do not contain a standard phosphorus atom. Substitutes for the phosphate can be for example, short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts. Numerous United States patents disclose how to make and use these types of phosphate replacements and include but are not limited to U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 15 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

It is also understood in a nucleotide substitute that both the sugar and the phosphate moieties of the nucleotide can be replaced, by for example an amide type linkage (aminoethylglycine) (PNA). U.S. Pat. Nos. 5,539,082; 5,714,331; and 5,719,262 teach how to make and use PNA molecules, each of which is herein incorporated by reference. (See also Nielsen et al., Science, 1991, 254, 1497-1500).

It is also possible to link other types of molecules (conjugates) to nucleotides or nucleotide analogs to enhance for example, cellular uptake. Conjugates can be chemically linked to the nucleotide or nucleotide analogs. Such conjugates include but are not limited to lipid moieties such as a cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al., Ann. N.Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Saison-Behmoaras et al., EMBO J., 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyl-oxycholesterol moiety (Crooke et al., J. Pharmacol. Exp. Ther., 1996, 277, 923-937. Numerous United States patents teach the preparation of such conjugates and include, but are not limited to U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 15 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference.

A Watson-Crick interaction is at least one interaction with the Watson-Crick face of a nucleotide, nucleotide analog, or nucleotide substitute. The Watson-Crick face of a nucleotide, nucleotide analog, or nucleotide substitute includes the C2, N1, and C6 positions of a purine based nucleotide, nucleotide analog, or nucleotide substitute and the C2, N3, C4 positions of a pyrimidine based nucleotide, nucleotide analog, or nucleotide substitute.

A Hoogsteen interaction is the interaction that takes place on the Hoogsteen face of a nucleotide or nucleotide analog, which is exposed in the major groove of duplex DNA. The Hoogsteen face includes the N7 position and reactive groups (NH2 or 0) at the C6 position of purine nucleotides.

b) Sequences

There are a variety of sequences related to the FVIII gene, these sequences and others are attached.

c) Primers and Probes

Disclosed are compositions including primers and probes, which are capable of interacting with the FVIII gene as disclosed herein. In certain embodiments the primers are used to support DNA amplification reactions. Typically the primers will be capable of being extended in a sequence specific manner Extension of a primer in a sequence specific manner includes any methods wherein the sequence and/or composition of the nucleic acid molecule to which the primer is hybridized or otherwise associated directs or influences the composition or sequence of the product produced by the extension of the primer. Extension of the primer in a sequence specific manner therefore includes, but is not limited to, PCR, DNA sequencing, DNA extension, DNA polymerization, RNA transcription, or reverse transcription. Techniques and conditions that amplify the primer in a sequence specific manner are preferred. In certain embodiments the primers are used for the DNA amplification reactions, such as PCR or direct sequencing. It is understood that in certain embodiments the primers can also be extended using non-enzymatic techniques, where for example, the nucleotides or oligonucleotides used to extend the primer are modified such that they will chemically react to extend the primer in a sequence specific manner Typically the disclosed primers hybridize with the FVIII gene or region of the FVIII gene or they hybridize with the complement of the FVIII gene or complement of a region of the FVIII gene.

The size of the primers or probes for interaction with the FVIII gene in certain embodiments can be any size that supports the desired enzymatic manipulation of the primer, such as DNA amplification or the simple hybridization of the probe or primer. A typical FVIII haplotype primer or probe would be at least 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 125, 150, 175, 200, 225, 250, 275, 300, 325, 350, 375, 400, 425, 450, 475, 500, 550, 600, 650, 700, 750, 800, 850, 900, 950, 1000, 1250, 1500, 1750, 2000, 2250, 2500, 2750, 3000, 3500, or 4000 nucleotides long.

In other embodiments the primer or probe can be less than or equal to 6, 7, 8, 9, 10, 11, 12 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 125, 150, 175, 200, 225, 250, 275, 300, 325, 350, 375, 400, 425, 450, 475, 500, 550, 600, 650, 700, 750, 800, 850, 900, 950, 1000, 1250, 1500, 1750, 2000, 2250, 2500, 2750, 3000, 3500, or 4000 nucleotides long.

The primers for the FVIII gene typically will be used to produce an amplified DNA product that contains the FVIII gene. In general, typically the size of the product will be such that the size can be accurately determined to within 3, or 2 or 1 nucleotides.

d) Nucleic Acid Delivery

The haplotypes disclosed herein can be useful with various methods of nucleic acid delivery. For example, in a subject with a given haplotype of FVIII, the corresponding nucleic acid of that haplotype can be administered to the subject, thereby increasing the amount of the proper haplotype if FVIII in that particular subject, thereby decreasing adverse reactions to the expressed protein. In the methods described above which include the administration and uptake of exogenous DNA into the cells of a subject (i.e., gene transduction or transfection), the disclosed nucleic acids can be in the form of naked DNA or RNA, or the nucleic acids can be in a vector for delivering the nucleic acids to the cells, whereby the antibody-encoding DNA fragment is under the transcriptional regulation of a promoter, as would be well understood by one of ordinary skill in the art. The vector can be a commercially available preparation, such as an adenovirus vector (Quantum Biotechnologies, Inc. (Laval, Quebec, Canada). Delivery of the nucleic acid or vector to cells can be via a variety of mechanisms. As one example, delivery can be via a liposome, using commercially available liposome preparations such as LIPOFECTIN, LIPOFECTAMINE (GIBCO-BRL, Inc., Gaithersburg, Md.), SUPERFECT (Qiagen, Inc. Hilden, Germany) and TRANSFECTAM (Promega Biotec, Inc., Madison, Wis.), as well as other liposomes developed according to procedures standard in the art. In addition, the disclosed nucleic acid or vector can be delivered in vivo by electroporation, the technology for which is available from Genetronics, Inc. (San Diego, Calif.) as well as by means of a SONOPORATION machine (ImaRx Pharmaceutical Corp., Tucson, Ariz.).

As one example, vector delivery can be via a viral system, such as a retroviral vector system which can package a recombinant retroviral genome (see e.g., Pastan et al., *Proc. Natl. Acad. Sci. U.S.A.* 85:4486, 1988; Miller et al., *Mol. Cell. Biol.* 6:2895, 1986). The recombinant retrovirus can then be used to infect and thereby deliver to the infected cells nucleic acid encoding a broadly neutralizing antibody (or active fragment thereof). The exact method of introducing the altered nucleic acid into mammalian cells is, of course, not limited to the use of retroviral vectors. Other techniques are widely available for this procedure including the use of adenoviral vectors (Mitani et al., *Hum. Gene Ther.* 5:941-948, 1994), adeno-associated viral (AAV) vectors (Goodman et al., *Blood* 84:14921500, 1994), lentiviral vectors (Naidini et al., *Science* 272:263-267, 1996), pseudotyped retroviral vectors (Agrawal et al., *Exper. Hematol.* 24:738-747, 1996). Physical transduction techniques can also be used, such as liposome delivery and receptor-mediated and other endocytosis mechanisms (see, for example, Schwartzenberger et al., *Blood* 87:472-478, 1996). This disclosed compositions and methods can be used in conjunction with any of these or other commonly used gene transfer methods.

As one example, if the antibody-encoding nucleic acid is delivered to the cells of a subject in an adenovirus vector, the dosage for administration of adenovirus to humans can range from about $10^7$ to $10^9$ plaque forming units (pfu) per injection but can be as high as $10^{12}$ pfu per injection (Crystal, *Hum. Gene Ther.* 8:985-1001, 1997; Alvarez and Curiel, *Hum. Gene Ther.* 8:597-613, 1997). A subject can receive a single injection, or, if additional injections are necessary, they can be repeated at six month intervals (or other appropriate time intervals, as determined by the skilled practitioner) for an indefinite period and/or until the efficacy of the treatment has been established.

Parenteral administration of the nucleic acid or vector, if used, is generally characterized by injection. Injectables can be prepared in conventional forms, either as liquid solutions or suspensions, solid forms suitable for solution of suspension in liquid prior to injection, or as emulsions. A more recently revised approach for parenteral administration involves use of a slow release or sustained release system such that a constant dosage is maintained. For additional discussion of suitable formulations and various routes of administration of therapeutic compounds, see, e.g., *Remington: The Science and Practice of Pharmacy* (19th ed.) ed. A. R. Gennaro, Mack Publishing Company, Easton, Pa. 1995.

There are a number of compositions and methods which can be used to deliver nucleic acids to cells, either in vitro or in vivo. These methods and compositions can largely be broken down into two classes: viral based delivery systems and non-viral based delivery systems. For example, the nucleic acids can be delivered through a number of direct delivery systems such as, electroporation, lipofection, calcium phosphate precipitation, plasmids, viral vectors, viral nucleic acids, phage nucleic acids, phages, cosmids, or via transfer of genetic material in cells or carriers such as cationic liposomes. Appropriate means for transfection, including viral vectors, chemical transfectants, or physico-mechanical methods such as electroporation and direct diffusion of DNA, are described by, for example, Wolff, J. A., et al., Science, 247, 1465-1468, (1990); and Wolff, J. A. Nature, 352, 815-818, (1991) Such methods are well known in the art and readily adaptable for use with the compositions and methods described herein. In certain cases, the methods will be modifed to specifically function with large DNA molecules. Further, these methods can be used to target certain diseases and cell populations by using the targeting characteristics of the carrier.

Transfer vectors can be any nucleotide construction used to deliver genes into cells (e.g., a plasmid), or as part of a general strategy to deliver genes, e.g., as part of recombinant retrovirus or adenovirus (Ram et al. Cancer Res. 53:83-88, (1993)).

As used herein, plasmid or viral vectors are agents that transport the disclosed nucleic acids, such as a given haplotype of FVIII into the cell without degradation and include a promoter yielding expression of the gene in the cells into which it is delivered. Viral vectors are, for example, Adenovirus, Adeno-associated virus, Herpes virus, Vaccinia virus, Polio virus, AIDS virus, neuronal trophic virus, Sindbis and other RNA viruses, including these viruses with the HIV backbone. Also preferred are any viral families which share the properties of these viruses which make them suitable for use as vectors. Retroviruses include Murine Maloney Leukemia virus, MMLV, and retroviruses that express the desirable properties of MMLV as a vector. Retroviral vectors are able to carry a larger genetic payload, i.e., a transgene or marker gene, than other viral vectors, and for this reason are a commonly used vector. However, they are not as useful in non-proliferating cells. Adenovirus vectors are relatively stable and easy to work with, have high titers, and can be delivered in aerosol formulation, and can transfect non-dividing cells. Pox viral vectors are large and have several sites for inserting genes, they are thermostable and can be stored at room temperature. A preferred embodiment is a viral vector which has been engineered so as to suppress the immune response of the host organism, elicited by the viral antigens. Preferred vectors of this type will carry coding regions for Interleukin 8 or 10.

Viral vectors can have higher transaction (ability to introduce genes) abilities than chemical or physical methods to introduce genes into cells. Typically, viral vectors contain, nonstructural early genes, structural late genes, an RNA polymerase III transcript, inverted terminal repeats necessary for replication and encapsidation, and promoters to control the transcription and replication of the viral genome. When engineered as vectors, viruses typically have one or more of the early genes removed and a gene or gene/promoter cassette is inserted into the viral genome in place of the removed viral DNA. Constructs of this type can carry up to about 8 kb of foreign genetic material. The necessary functions of the removed early genes are typically supplied by cell lines which have been engineered to express the gene products of the early genes in trans.

(1) Retroviral Vectors

A retrovirus is an animal virus belonging to the virus family of Retroviridae, including any types, subfamilies, genus, or tropisms. Retroviral vectors, in general, are described by Verma, I. M., Retroviral vectors for gene transfer. In Microbiology-1985, American Society for Microbiology, pp. 229-232, Washington, (1985), which is incorporated by reference herein. Examples of methods for using retroviral vectors for gene therapy are described in U.S. Pat. Nos. 4,868,116 and 4,980,286; PCT applications WO 90/02806 and WO 89/07136; and Mulligan, (Science 260:926-932 (1993)); the teachings of which are incorporated herein by reference.

A retrovirus is essentially a package which has packed into it nucleic acid cargo. The nucleic acid cargo carries with it a packaging signal, which ensures that the replicated daughter molecules will be efficiently packaged within the package coat. In addition to the package signal, there are a number of molecules which are needed in cis, for the replication, and packaging of the replicated virus. Typically a retroviral genome, contains the gag, pol, and env genes which are involved in the making of the protein coat. It is the gag, pol, and env genes which are typically replaced by the foreign DNA that it is to be transferred to the target cell. Retrovirus vectors typically contain a packaging signal for incorporation into the package coat, a sequence which signals the start of the gag transcription unit, elements necessary for reverse transcription, including a primer binding site to bind the tRNA primer of reverse transcription, terminal repeat sequences that guide the switch of RNA strands during DNA synthesis, a purine rich sequence 5' to the 3' LTR that serve as the priming site for the synthesis of the second strand of DNA synthesis, and specific sequences near the ends of the LTRs that enable the insertion of the DNA state of the retrovirus to insert into the host genome. The removal of the gag, pol, and env genes allows for about 8 kb of foreign sequence to be inserted into the viral genome, become reverse transcribed, and upon replication be packaged into a new retroviral particle. This amount of nucleic acid is sufficient for the delivery of a one to many genes depending on the size of each transcript. It is preferable to include either positive or negative selectable markers along with other genes in the insert.

Since the replication machinery and packaging proteins in most retroviral vectors have been removed (gag, pol, and env), the vectors are typically generated by placing them into a packaging cell line. A packaging cell line is a cell line which has been transfected or transformed with a retrovirus that contains the replication and packaging machinery, but lacks any packaging signal. When the vector carrying the DNA of choice is transfected into these cell lines, the vector containing the gene of interest is replicated and packaged into new retroviral particles, by the machinery provided in cis by the helper cell. The genomes for the machinery are not packaged because they lack the necessary signals.

(2) Adenoviral Vectors

The construction of replication-defective adenoviruses has been described (Berkner et al., J. Virology 61:1213-1220 (1987); Massie et al., Mol. Cell. Biol. 6:2872-2883 (1986); Haj-Ahmad et al., J. Virology 57:267-274 (1986); Davidson et al., J. Virology 61:1226-1239 (1987); Zhang "Generation and identification of recombinant adenovirus by liposome-mediated transfection and PCR analysis" BioTechniques 15:868-872 (1993)). The benefit of the use of these viruses as vectors is that they are limited in the extent to which they can spread to other cell types, since they can replicate within an initial infected cell, but are unable to form new infectious viral particles. Recombinant adenoviruses have been shown to achieve high efficiency gene transfer after direct, in vivo delivery to airway epithelium, hepatocytes, vascular endothelium, CNS parenchyma and a number of other tissue sites (Morsy, J. Clin. Invest. 92:1580-1586 (1993); Kirshenbaum, J. Clin. Invest. 92:381-387 (1993); Roessler, J. Clin. Invest. 92:1085-1092 (1993); Moullier, Nature Genetics 4:154-159 (1993); La Salle, Science 259:988-990 (1993); Gomez-Foix, J. Biol. Chem. 267:25129-25134 (1992); Rich, Human Gene Therapy 4:461-476 (1993); Zabner, Nature Genetics 6:75-83 (1994); Guzman, Circulation Research 73:1201-1207 (1993); Bout, Human Gene Therapy 5:3-10 (1994); Zabner, Cell 75:207-216 (1993); Caillaud, Eur. J. Neuroscience 5:1287-1291 (1993); and Ragot, J. Gen. Virology 74:501-507 (1993)). Recombinant adenoviruses achieve gene transduction by binding to specific cell surface receptors, after which the virus is internalized by receptor-mediated endocytosis, in the same manner as wild type or replication-defective adenovirus (Chardonnet and Dales, Virology 40:462-477 (1970); Brown and Burlingham, J. Virology 12:386-396 (1973); Svensson and Persson, J. Virology 55:442-449 (1985); Seth, et al., J. Virol. 51:650-655 (1984); Seth, et al., Mol. Cell. Biol. 4:1528-

1533 (1984); Varga et al., J. Virology 65:6061-6070 (1991); Wickham et al., Cell 73:309-319 (1993)).

A viral vector can be one based on an adenovirus which has had the E1 gene removed and these virons are generated in a cell line such as the human 293 cell line. In another preferred embodiment both the E1 and E3 genes are removed from the adenovirus genome.

(3) Adeno-Asscociated Viral Vectors

Another type of viral vector is based on an adeno-associated virus (AAV). This defective parvovirus is a preferred vector because it can infect many cell types and is nonpathogenic to humans. AAV type vectors can transport about 4 to 5 kb and wild type AAV is known to stably insert into chromosome 19. Vectors which contain this site specific integration property are preferred. An especially preferred embodiment of this type of vector is the P4.1 C vector produced by Avigen, San Francisco, Calif., which can contain the herpes simplex virus thymidine kinase gene, HSV-tk, and/or a marker gene, such as the gene encoding the green fluorescent protein, GFP.

In another type of AAV virus, the AAV contains a pair of inverted terminal repeats (ITRs) which flank at least one cassette containing a promoter which directs cell-specific expression operably linked to a heterologous gene. Heterologous in this context refers to any nucleotide sequence or gene which is not native to the AAV or B19 parvovirus.

Typically the AAV and B19 coding regions have been deleted, resulting in a safe, noncytotoxic vector. The AAV ITRs, or modifications thereof, confer infectivity and site-specific integration, but not cytotoxicity, and the promoter directs cell-specific expression. U.S. Pat. No. 6,261,834 is herein incorporated by reference for material related to the AAV vector.

The disclosed vectors thus provide DNA molecules which are capable of integration into a mammalian chromosome without substantial toxicity.

The inserted genes in viral and retroviral usually contain promoters, and/or enhancers to help control the expression of the desired gene product. A promoter is generally a sequence or sequences of DNA that function when in a relatively fixed location in regard to the transcription start site. A promoter contains core elements required for basic interaction of RNA polymerase and transcription factors, and may contain upstream elements and response elements.

(4) Large Payload Viral Vectors

Molecular genetic experiments with large human herpesviruses have provided a means whereby large heterologous DNA fragments can be cloned, propagated and established in cells permissive for infection with herpesviruses (Sun et al., Nature genetics 8: 33-41, 1994; Cotter and Robertson, Curr Opin Mol Ther 5: 633-644, 1999). These large DNA viruses (herpes simplex virus (HSV) and Epstein-Barr virus (EBV), have the potential to deliver fragments of human heterologous DNA>150 kb to specific cells. EBV recombinants can maintain large pieces of DNA in the infected B-cells as episomal DNA. Individual clones carried human genomic inserts up to 330 kb appeared genetically stable The maintenance of these episomes requires a specific EBV nuclear protein, EBNA1, constitutively expressed during infection with EBV. Additionally, these vectors can be used for transfection, where large amounts of protein can be generated transiently in vitro. Herpesvirus amplicon systems are also being used to package pieces of DNA>220 kb and to infect cells that can stably maintain DNA as episomes.

Other useful systems include, for example, replicating and host-restricted non-replicating vaccinia virus vectors.

e) Non-Nucleic Acid Based Systems

The disclosed compositions can be delivered to the target cells in a variety of ways. For example, the compositions can be delivered through electroporation, or 0 through lipofection, or through calcium phosphate precipitation. The delivery mechanism chosen will depend in part on the type of cell targeted and whether the delivery is occurring for example in vivo or in vitro.

Thus, the compositions can comprise, in addition to the disclosed genes or vectors for example, lipids such as liposomes, such as cationic liposomes (e.g., DOTMA, DOPE, DC-cholesterol) or anionic liposomes. Liposomes can further comprise proteins to facilitate targeting a particular cell, if desired. Administration of a composition comprising a compound and a cationic liposome can be administered to the blood afferent to a target organ or inhaled into the respiratory tract to target cells of the respiratory tract. Regarding liposomes, see, e.g., Brigham et al. Am. J. Resp. Cell. Mol. Biol. 1:95-100 (1989); Felgner et al. Proc. Natl. Acad. Sci USA 84:7413-7417 (1987); U.S. Pat. No. 4,897,355. Furthermore, the compound can be administered as a component of a microcapsule that can be targeted to specific cell types, such as macrophages, or where the diffusion of the compound or delivery of the compound from the microcapsule is designed for a specific rate or dosage.

In the methods described above which include the administration and uptake of exogenous DNA into the cells of a subject (i.e., gene transduction or transfection), delivery of the compositions to cells can be via a variety of mechanisms. As one example, delivery can be via a liposome, using commercially available liposome preparations such as LIPOFECTIN, LEPOFECTAMINE (GIBCO-BRL, Inc., Gaithersburg, Md.), SUPERFECT (Qiagen, Inc. Hilden, Germany) and TRANSFECTAM (Promega Biotec, Inc., Madison, Wis.), as well as other liposomes developed according to procedures standard in the art. In addition, the disclosed nucleic acid or vector can be delivered in vivo by electroporation, the technology for which is available from Genetronics, Inc. (San Diego, Calif.) as well as by means of a SONOPORATION machine (ImaRx Pharmaceutical Corp., Tucson, Ariz.).

The materials may be in solution, suspension (for example, incorporated into microparticles, liposomes, or cells). These may be targeted to a particular cell type via antibodies, receptors, or receptor ligands. The following references are examples of the use of this technology to target specific proteins to tumor tissue (Senter, et al., Bioconjugate Chem., 2:447-451, (1991); Bagshawe, K. D., Br. J. Cancer, 60:275-281, (1989); Bagshawe, et al., Br. J. Cancer, 58:700-703, (1988); Senter, et al., Bioconjugate Chem., 4:3-9, (1993); Battelli, et al., Cancer Immunol. Immunother., 35:421-425, (1992); Pietersz and McKenzie, Immunlog. Reviews, 129:57-80, (1992); and Roffler, et al., Biochem. Pharmacol, 42:2062-2065, (1991)). These techniques can be used for a variety of other speciifc cell types. Vehicles such as "stealth" and other antibody conjugated liposomes (including lipid mediated drug targeting to colonic carcinoma), receptor mediated targeting of DNA through cell specific ligands, lymphocyte directed tumor targeting, and highly specific therapeutic retroviral targeting of murine glioma cells in vivo. The following references are examples of the use of this technology to target specific proteins to tumor tissue (Hughes et al., Cancer Research, 49:6214-6220, (1989); and Litzinger and Huang, Biochimica et Biophysica Acta, 1104:179-187, (1992)). In general, receptors are involved in pathways of endocytosis, either constitutive or ligand induced. These receptors cluster in clathrin-coated pits, enter the cell via clathrin-coated vesicles, pass through an acidified endosome in which the receptors are sorted, and then either recycle to the cell surface, become stored intracellularly, or are degraded in lysosomes. The internalization pathways serve a variety of functions, such as nutrient uptake, removal of activated proteins, clearance of macromolecules, opportunistic entry of viruses and toxins, dissociation and degradation of ligand, and receptor-level regulation. Many receptors follow more than one intracellular pathway, depending on the cell type, receptor concentration, type of ligand, ligand valency, and ligand concentration. Molecular and cellular mechanisms of receptor-mediated endocytosis has been reviewed (Brown and Greene, *DNA and Cell Biology* 10:6, 399-409 (1991)).

Nucleic acids that are delivered to cells which are to be integrated into the host cell genome, typically contain integration sequences. These sequences are often viral related sequences, particularly when viral based systems are used. These viral intergration systems can also be incorporated into nucleic acids which are to be delivered using a non-nucleic acid based system of deliver, such as a liposome, so that the nucleic acid contained in the delivery system can be come integrated into the host genome.

Other general techniques for integration into the host genome include, for example, systems designed to promote homologous recombination with the host genome. These systems typically rely on sequence flanking the nucleic acid to be expressed that has enough homology with a target sequence within the host cell genome that recombination between the vector nucleic acid and the target nucleic acid takes place, causing the delivered nucleic acid to be integrated into the host genome. These systems and the methods necessary to promote homologous recombination are known to those of skill in the art.

f) In Vivo/Ex Vivo

As described above, the compositions can be administered in a pharmaceutically acceptable carrier and can be delivered to the subject=s cells in vivo and/or ex vivo by a variety of mechanisms well known in the art (e.g., uptake of naked. DNA, liposome fusion, intramuscular injection of DNA via a gene gun, endocytosis and the like).

If ex vivo methods are employed, cells or tissues can be removed and maintained outside the body according to standard protocols well known in the art. The compositions can be introduced into the cells via any gene transfer mechanism, such as, for example, calcium phosphate mediated gene delivery, electroporation, microinjection or proteoliposomes. The transduced cells can then be infused (e.g., in a pharmaceutically acceptable carrier) or homotopically transplanted back into the subject per standard methods for the cell or tissue type. Standard methods are known for transplantation or infusion of various cells into a subject.

4. Expression Systems

The nucleic acids that are delivered to cells typically contain expression controlling systems. For example, the inserted genes in viral and retroviral systems usually contain promoters, and/or enhancers to help control the expression of the desired gene product. A promoter is generally a sequence or sequences of DNA that function when in a relatively fixed location in regard to the transcription start site. A promoter contains core elements required for basic interaction of RNA polymerase and transcription factors, and may contain upstream elements and response elements.

a) Viral Promoters and Enhancers

Preferred promoters controlling transcription from vectors in mammalian host cells may be obtained from various sources, for example, the genomes of viruses such as: polyoma, Simian Virus 40 (SV40), adenovirus, retroviruses, hepatitis-B virus and most preferably cytomegalovirus, or from heterologous mammalian promoters, e.g. beta actin promoter. The early and late promoters of the SV40 virus are conveniently obtained as an SV40 restriction fragment which also contains the SV40 viral origin of replication (Fiers et al., *Nature,* 273: 113 (1978)). The immediate early promoter of the human cytomegalovirus is conveniently obtained as a HindIII E restriction fragment (Greenway, P. J. et al., *Gene* 18: 355-360 (1982)). Of course, promoters from the host cell or related species also are useful herein.

Enhancer generally refers to a sequence of DNA that functions at no fixed distance from the transcription start site and can be either 5' (Laimins, L. et al., *Proc. Natl. Acad. Sci.* 78: 993 (1981)) or 3' (Lusky, M. L., et al., *Mol. Cell Bio.* 3: 1108 (1983)) to the transcription unit. Furthermore, enhancers can be within an intron (Banerji, J. L. et al., Cell 33: 729 (1983)) as well as within the coding sequence itself (Osborne, T. F., et al., *Mol. Cell Bio.* 4: 1293 (1984)). They are usually between 10 and 300 by in length, and they function in cis. Enhancers f unction to increase transcription from nearby promoters. Enhancers also often contain response elements that mediate the regulation of transcription. Promoters can also contain response elements that mediate the regulation of transcription. Enhancers often determine the regulation of expression of a gene. While many enhancer sequences are now known from mammalian genes (globin, elastase, albumin, -fetoprotein and insulin), typically one will use an enhancer from a eukaryotic cell virus for general expression. Preferred examples are the SV40 enhancer on the late side of the replication origin (bp 100-270), the cytomegalovirus early promoter enhancer, the polyoma enhancer on the late side of the replication origin, and adenovirus enhancers.

The promotor and/or enhancer may be specifically activated either by light or specific chemical events which trigger their function. Systems can be regulated by reagents such as tetracycline and dexamethasone. There are also ways to enhance viral vector gene expression by exposure to irradiation, such as gamma irradiation, or alkylating chemotherapy drugs.

In certain embodiments the promoter and/or enhancer region can act as a constitutive promoter and/or enhancer to maximize expression of the region of the transcription unit to be transcribed. In certain constructs the promoter and/or enhancer region be active in all eukaryotic cell types, even if it is only expressed in a particular type of cell at a particular time. A preferred promoter of this type is the CMV promoter (650 bases). Other preferred promoters are SV40 promoters, cytomegalovirus (full length promoter), and retroviral vector LTR.

It has been shown that all specific regulatory elements can be cloned and used to construct expression vectors that are selectively expressed in specific cell types such as melanoma cells. The glial fibrillary acetic protein (GFAP) promoter has been used to selectively express genes in cells of glial origin.

Expression vectors used in eukaryotic host cells (yeast, fungi, insect, plant, animal, human or nucleated cells) may also contain sequences necessary for the termination of transcription which may affect mRNA expression. These regions are transcribed as polyadenylated segments in the untranslated portion of the mRNA encoding tissue factor protein. The 3' untranslated regions also include transcription termination sites. It is preferred that the transcription unit also contain a polyadenylation region. One benefit of this region is that it increases the likelihood that the transcribed unit will be processed and transported like mRNA.

The identification and use of polyadenylation signals in expression constructs is well established. It is preferred that homologous polyadenylation signals be used in the transgene constructs. In certain transcription units, the polyadenylation region is derived from the SV40 early polyadenylation signal and consists of about 400 bases. It is also preferred that the transcribed units contain other standard sequences alone or in combination with the above sequences improve expression from, or stability of, the construct.

b) Markers

The viral vectors can include nucleic acid sequence encoding a marker product. This marker product is used to determine if the gene has been delivered to the cell and once delivered is being expressed. Preferred marker genes are the E. Coli lacZ gene, which encodes β-galactosidase, and green fluorescent protein.

In some embodiments the marker may be a selectable marker. Examples of suitable selectable markers for mammalian cells are dihych-ofolate reductase (DHFR), thymidine kinase, neomycin, neomycin analog G418, hydromycin, and puromycin. When such selectable markers are successfully transferred into a mammalian host cell, the transformed mammalian host cell can survive if placed under selective pressure. There are two widely used distinct categories of selective regimes. The first category is based on a cell's metabolism and the use of a mutant cell line which lacks the ability to grow independent of a supplemented media. Two examples are: CHO DHFR-cells and mouse LTK-cells. These cells lack the ability to grow without the addition of such nutrients as thymidine or hypoxanthine. Because these cells lack certain genes necessary for a complete nucleotide synthesis pathway, they cannot survive unless the missing nucleotides are provided in a supplemented media. An alternative to supplementing the media is to introduce an intact DHFR or TK gene into cells lacking the respective genes, thus altering their growth requirements. Individual cells which were not transformed with the DHFR or TK gene will not be capable of survival in non-supplemented media.

The second category is dominant selection which refers to a selection scheme used in any cell type and does not require the use of a mutant cell line. These schemes typically use a drug to arrest growth of a host cell. Those cells which have a novel gene would express a protein conveying drug resistance and would survive the selection. Examples of such dominant selection use the drugs neomycin, (Southern P. and Berg, P., *J. Molec. Appl. Genet.* 1: 327 (1982)), mycophenolic acid, (Mulligan, R. C. and Berg, P. *Science* 209: 1422 (1980)) or hygromycin, (Sugden, B. et al., *Mol. Cell. Biol.* 5: 410-413 (1985)). The three examples employ bacterial genes under eukaryotic control to convey resistance to the appropriate drug G418 or neomycin (geneticin), xgpt (mycophenolic acid) or hygromycin, respectively. Others include the neomycin analog G418 and puramycin.

5. Peptides a) Protein Variants

As discussed herein there are numerous variants of the FVIII protein that are disclosed. As described above, the present invention provides at least four common non-synonymous-single-nucleotide-polymorphisms (nsSNPs), combinations of which represent six naturally-occurring allelic variants of the FVIII protein in the human population (FIG. 2). As such, six different haplotypic forms of the wt FVIII protein have been identified. These haplotypic forms have been designated: H1, H2, H3, H4, H5, and H6 (FIG. 3). Each of these variants represents a normal allelic variant of the FVIII protein since the individuals from whom the sequences were described have no bleeding disorders.

Protein variation, as described herein, applies generally to the design, synthesis, and recogniztion of proteins. However, the present invention is drawn to specific haplotypes with specific nucleic acid, and amino acid, sequences. These sequences need not be varied as disclosed herein, but can optionally contain other variances than those disclosed in haplotypes H1-H6.

Amino acid sequence modifications typically fall into one or more of three classes: substitutional, insertional or deletional variants. Insertions include amino and/or carboxyl terminal fusions as well as intrasequence insertions of single or multiple amino acid residues. Insertions ordinarily will be smaller insertions than those of amino or carboxyl terminal fusions, for example, on the order of one to four residues Immunogenic fusion protein derivatives, such as those described in the examples, are made by fusing a polypeptide sufficiently large to confer immunogenicity to the target sequence by cross-linking in vitro or by recombinant cell culture transformed with DNA encoding the fusion. Deletions are characterized by the removal of one or more amino acid residues from the protein sequence. Typically, no more than about from 2 to 6 residues are deleted at any one site within the protein molecule. These variants ordinarily are prepared by site specific mutagenesis of nucleotides in the DNA encoding the protein, thereby producing DNA encoding the variant, and thereafter expressing the DNA in recombinant cell culture. Techniques for making substitution mutations at predetermined sites in DNA having a known sequence are well known, for example M13 primer mutagenesis and PCR mutagenesis. Amino acid substitutions are typically of single residues, but can occur at a number of different locations at once; insertions usually will be on the order of about from 1 to 10 amino acid residues; and deletions will range about from 1 to 30 residues. Deletions or insertions preferably are made in adjacent pairs, i.e. a deletion of 2 residues or insertion of 2 residues. Substitutions, deletions, insertions or any combination thereof may be combined to arrive at a final construct. The mutations must not place the sequence out of reading frame and preferably will not create complementary regions that could produce secondary mRNA structure. Substitutional variants are those in which at least one residue has been removed and a different residue inserted in its place. Such substitutions generally are made in accordance with the following Tables AAA and AAS and are referred to as conservative substitutions.

TABLE AAA

Amino Acid Abbreviations

| Amino Acid | Abbreviations |
| --- | --- |
| alanine | Ala, A |
| alloisoleucine | Alle |
| arginine | Arg, R |
| asparagine | Asn, N |
| aspartic acid | Asp, D |
| cysteine | Cys, C |
| glutamic acid | Glu, E |
| glutamine | Gln, K |
| Glycine | Gly, G |
| Histidine | His, H |
| Isoleucine | Ile, I |
| Leucine | Leu, L |
| Lysine | Lys, K |
| phenylalanine | Phe, F |
| Proline | Pro, P |

TABLE AAA-continued

Amino Acid Abbreviations

| Amino Acid | Abbreviations |
|---|---|
| pyroglutamic acid | pGlu |
| Serine | Ser, S |
| Threonine | Thr, T |
| Tyrosine | Tyr, Y |
| Tryptophan | Trp, W |
| Valine | Val, V |

TABLE AAS

Amino Acid Substitutions

| Original Residue | Exemplary Conservative Substitutions, others are known in the art. |
|---|---|
| Ala | Ser |
| Arg | Lys; Gln |
| Asn | Gln; His |
| Asp | Glu |
| Cys | Ser |
| Gln | Asn; Lys |
| Glu | Asp |
| Gly | Pro |
| His | Asn; Gln |
| Ile | Leu; Val |
| Leu | Ile; Val |
| Lys | Arg; Gln |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

Substantial changes in function or immunological identity are made by selecting substitutions that are less conservative than those in Table AAS, i.e., selecting residues that differ more significantly in their effect on maintaining (a) the structure of the polypeptide backbone in the area of the substitution, for example as a sheet or helical conformation, (b) the charge or hydrophobicity of the molecule at the target site or (c) the bulk of the side chain. The substitutions which in general are expected to produce the greatest changes in the protein properties will be those in which (a) a hydrophilic residue, e.g. seryl or threonyl, is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g., lysyl, arginyl, or histidyl, is substituted for (or by) an electronegative residue, e.g., glutamyl or aspartyl; or (d) a residue having a bulky side chain, e.g., phenylalanine, is substituted for (or by) one not having a side chain, e.g., glycine, in this case, (e) by increasing the number of sites for sulfation and/or glycosylation.

For example, the replacement of one amino acid residue with another that is biologically and/or chemically similar is known to those skilled in the art as a conservative substitution. For example, a conservative substitution would be replacing one hydrophobic residue for another, or one polar residue for another. The substitutions include combinations such as, for example, Gly, Ala; Val, Ile, Leu; Asp, Glu; Asn, Gln; Ser, Thr; Lys, Arg; and Phe, Tyr. Such conservatively substituted variations of each explicitly disclosed sequence are included within the mosaic polypeptides provided herein.

Substitutional or deletional mutagenesis can be employed to insert sites for N-glycosylation (Asn-X-Thr/Ser) or O-glycosylation (Ser or Thr). Deletions of cysteine or other labile residues also may be desirable. Deletions or substitutions of potential proteolysis sites, e.g. Arg, is accomplished for example by deleting one of the basic residues or substituting one by glutaminyl or histidyl residues.

Certain post-translational derivatizations are the result of the action of recombinant host cells on the expressed polypeptide. Glutaminyl and asparaginyl residues are frequently post-translationally deamidated to the corresponding glutamyl and asparyl residues. Alternatively, these residues are deamidated under mildly acidic conditions. Other post-translational modifications include hydroxylation of proline and lysine, phosphorylation of hydroxyl groups of seryl or threonyl residues, methylation of the o-amino groups of lysine, arginine, and histidine side chains (T. E. Creighton, Proteins: Structure and Molecular Properties, W. H. Freeman & Co., San Francisco pp 79-86 [1983]), acetylation of the N-terminal amine and, in some instances, amidation of the C-terminal carboxyl.

It is understood that one way to define the variants and derivatives of the disclosed proteins herein is through defining the variants and derivatives in terms of homology/identity to specific known sequences. Specifically disclosed are variants of these and other proteins herein disclosed which have at least, 70% or 75% or 80% or 85% or 90% or 95% homology to the stated sequence. Those of skill in the art readily understand how to determine the homology of two proteins. For example, the homology can be calculated after aligning the two sequences so that the homology is at its highest level.

Another way of calculating homology can be performed by published algorithms. Optimal alignment of sequences for comparison may be conducted by the local homology algorithm of Smith and Waterman Adv. Appl. Math. 2: 482 (1981), by the homology alignment algorithm of Needleman and Wunsch, J. MoL Biol. 48: 443 (1970), by the search for similarity method of Pearson and Lipman, Proc. Natl. Acad. Sci. U.S.A. 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by inspection.

The same types of homology can be obtained for nucleic acids by for example the algorithms disclosed in Zuker, M. Science 244:48-52, 1989, Jaeger et al. Proc. Natl. Acad. Sci. USA 86:7706-7710, 1989, Jaeger et al. Methods Enzymol. 183:281-306, 1989 which are herein incorporated by reference for at least material related to nucleic acid alignment.

It is understood that the description of conservative mutations and homology can be combined together in any combination, such as embodiments that have at least 70% homology to a particular sequence wherein the variants are conservative mutations.

As this specification discusses various proteins and protein sequences it is understood that the nucleic acids that can encode those protein sequences are also disclosed. This would include all degenerate sequences related to a specific protein sequence, i.e. all nucleic acids having a sequence that encodes one particular protein sequence as well as all nucleic acids, including degenerate nucleic acids, encoding the disclosed variants and derivatives of the protein sequences. Thus, while each particular nucleic acid sequence may not be written out herein, it is understood that each and every sequence is in fact disclosed and described herein through the disclosed protein sequence. It is also understood that while no amino acid sequence indicates what particular DNA sequence encodes that protein within an organism, where particular variants of a disclosed protein are disclosed herein, the known nucleic acid sequence that encodes that protein in the particular gene from which that protein arises is also known and herein disclosed and described.

It is understood that there are numerous amino acid and peptide analogs which can be incorporated into the disclosed compositions. For example, there are numerous D amino acids or amino acids which have a different functional substituent then the amino acids shown in Table AAA and Table AAS. The opposite stereo isomers of naturally occurring peptides are disclosed, as well as the stereo isomers of peptide analogs. These amino acids can readily be incorporated into polypeptide chains by charging tRNA molecules with the amino acid of choice and engineering genetic constructs that utilize, for example, amber codons, to insert the analog amino acid into a peptide chain in a site specific way (Thorson et al., Methods in Molec. Biol. 77:43-73 (1991), Zoller, Current Opinion in Biotechnology, 3:348-354 (1992); Ibba, Biotechnology & Genetic Engineering Reviews 13:197-216 (1995), Cahill et al., TIBS, 14(10):400-403 (1989); Benner, TIB Tech, 12:158-163 (1994); Ibba and Hennecke, Bio/technology, 12:678-682 (1994) all of which are herein incorporated by reference at least for material related to amino acid analogs).

Molecules can be produced that resemble peptides, but which are not connected via a natural peptide linkage. For example, linkages for amino acids or amino acid analogs can include $CH_2NH$—, —$CH_2S$—, —$CH_2$—$CH_2$—$CH$=$CH$— (cis and trans), —$COCH_2$—, —$CH(OH)$ $CH_2$—, and —$CHH_2SO$— (These and others can be found in Spatola, A. F. in Chemistry and Biochemistry of Amino Acids, Peptides, and Proteins, B. Weinstein, eds., Marcel Dekker, New York, p. 267 (1983); Spatola, A. F., Vega Data (March 1983), Vol. 1, Issue 3, Peptide Backbone Modifications (general review); Morley, Trends Pharm Sci (1980) pp. 463-468; Hudson, D. et al., Int J Pept Prot Res 14:177-185 (1979) (—$CH_2NH$—, $CH_2CH_2$—); Spatola et al. Life Sci 38:1243-1249 (1986) (—CH $H_2$—S); Hann J. Chem. Soc Perkin Trans. I 307-314 (1982) (—CH—CH—, cis and trans); Almquist et al. J. Med. Chem. 23:1392-1398 (1980) (—$COCH_2$—); Jennings-White et al. Tetrahedron Lett 23:2533 (1982) (—$COCH_2$—); Szelke et al. European Appin, EP 45665 CA (1982): 97:39405 (1982) (—CH(OH) $CH_2$—); Holladay et al. Tetrahedron. Lett 24:4401-4404 (1983) (—$C(OH)CH_2$—); and Hruby Life Sci 31:189-199 (1982) (—$CH_2$—S—); each of which is incorporated herein by reference. A particularly preferred non-peptide linkage is —$CH_2NH$—. It is understood that peptide analogs can have more than one atom between the bond atoms, such as b-alanine, g-aminobutyric acid, and the like.

Amino acid analogs and analogs and peptide analogs often have enhanced or desirable properties, such as, more economical production, greater chemical stability, enhanced pharmacological properties (half-life, absorption, potency, efficacy, etc.), altered specificity (e.g., a broad-spectrum of biological activities), reduced antigenicity, and others.

D-amino acids can be used to generate more stable peptides, because D amino acids are not recognized by peptidases and such. Systematic substitution of one or more amino acids of a consensus sequence with a D-amino acid of the same type (e.g., D-lysine in place of L-lysine) can be used to generate more stable peptides. Cysteine residues can be used to cyclize or attach two or more peptides together. This can be beneficial to constrain peptides into particular conformations. (Rizo and Gierasch Ann. Rev. Biochem. 61:387 (1992), incorporated herein by reference).

6. Antibodies (1) Antibodies Generally

The term "antibodies" is used herein in a broad sense and includes both polyclonal and monoclonal antibodies. In addition to intact immunoglobulin molecules, also included in the term "antibodies" are fragments or polymers of those immunoglobulin molecules, and human or humanized versions of immunoglobulin molecules or fragments thereof, as long as they are chosen for their ability to interact with a specific haplotype of FVIII such that FVIII is inhibited, for example. The antibodies can be tested for their desired activity using the in vitro assays described herein, or by analogous methods, after which their in vivo therapeutic and/or prophylactic activities are tested according to known clinical testing methods.

The term "monoclonal antibody" as used herein refers to an antibody obtained from a substantially homogeneous population of antibodies, i.e., the individual antibodies within the population are identical except for possible naturally occurring mutations that may be present in a small subset of the antibody molecules. The monoclonal antibodies herein specifically include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, as long as they exhibit the desired antagonistic activity (See, U.S. Pat. No. 4,816,567 and Morrison et al., *Proc. Nati. Acad. Sci. USA,* 81:6851-6855 (1984)).

The disclosed monoclonal antibodies can be made using any procedure which produces monoclonal antibodies. For example, disclosed monoclonal antibodies can be prepared using hybridoma methods, such as those described by Kohler and Milstein, Nature, 256:495 (1975). In a hybridoma method, a mouse or other appropriate host animal is typically immunized with an immunizing agent to elicit lymphocytes that produce or are capable of producing antibodies that will specifically bind to the immunizing agent. Alternatively, the lymphocytes may be immunized in vitro, e.g., using the HIV Env-CD4-co-receptor complexes described herein.

The monoclonal antibodies may also be made by recombinant DNA methods, such as those described in U.S. Pat. No. 4,816,567 (Cabilly et al.). DNA encoding the disclosed monoclonal antibodies can be readily isolated and sequenced using conventional procedures (e.g., by using oligonucleotide probes that are capable of binding specifically to genes encoding the heavy and light chains of murine antibodies). Libraries of antibodies or active antibody fragments can also be generated and screened using phage display techniques, e.g., as described in U.S. Pat. No. 5,804,440 to Burton et al. and U.S. Pat. No. 6,096,441 to Barbas et al.

In vitro methods are also suitable for preparing monovalent antibodies. Digestion of antibodies to produce fragments thereof, particularly, Fab fragments, can be accomplished using routine techniques known in the art. For instance, digestion can be performed using papain. Examples of papain digestion are described in WO 94/29348 published Dec. 22, 1994 and U.S. Pat. No. 4,342,566. Papain digestion of antibodies typically produces two identical antigen binding fragments, called Fab fragments, each with a single antigen binding site, and a residual Fc fragment. Pepsin treatment yields a fragment that has two antigen combining sites and is still capable of cross-linking antigen.

The fragments, whether attached to other sequences or not, can also include insertions, deletions, substitutions, or other selected modifications of particular regions or specific amino acids residues, provided the activity of the antibody or antibody fragment is not significantly altered or impaired compared to the non-modified antibody or antibody fragment. These modifications can provide for some additional property, such as to remove/add amino acids capable of disulfide bonding, to increase its bio-longevity, to alter its secretory characteristics, etc. In any case, the antibody or antibody fragment must possess a bioactive property, such as specific binding to its cognate antigen. Functional or active regions of the antibody or antibody fragment may be identified by mutagenesis of a specific region of the protein, followed by expression and testing of the expressed polypeptide. Such methods are readily apparent to a skilled practitioner in the art and can include site-specific mutagenesis of the nucleic acid encoding the antibody or antibody fragment. (Zoller, M. J. *Curr. Opin. Biotechnol.* 3:348-354, 1992).

As used herein, the term "antibody" or "antibodies" can also refer to a human antibody and/or a humanized antibody. Many non-human antibodies (e.g., those derived from mice, rats, or rabbits) are naturally antigenic in humans, and thus can give rise to undesirable immune responses when administered to humans. Therefore, the use of human or humanized antibodies in the methods serves to lessen the chance that an antibody administered to a human will evoke an undesirable immune response.

FVBI inhibitor antibody neutralizing antibodies can be administered to neutralize endogenous FVIII inhibitor antibodies.

(2) Human Antibodies

The disclosed human antibodies can be prepared using any technique. Examples of techniques for human monoclonal antibody production include those described by Cole et al. (*Monoclonal Antibodies and Cancer Therapy*, Alan R. Liss, p. 77, 1985) and by Boerner et al. (*J. Inzmunol.*, 147(1):86-95, 1991). Human antibodies (and fragments thereof) can also be produced using phage display libraries (Hoogenboom et al., *J. Mol. Biol.*, 227:381, 1991; Marks et al., *J. Mol. Biol*, 222:581, 1991).

The disclosed human antibodies can also be obtained from transgenic animals. For example, transgenic, mutant mice that are capable of producing a full repertoire of human antibodies, in response to immunization, have been described (see, e.g., Jakobovits et al., *Proc. Natl. Acad. Sci. USA,* 90:2551-255 (1993); Jakobovits et al., *Nature,* 362: 255-258 (1993); Bruggermann et al., *Year in Immunol.,* 7:33 (1993)). Specifically, the homozygous deletion of the antibody heavy chain joining region (J(H)) gene in these chimeric and germ-line mutant mice results in complete inhibition of endogenous antibody production, and the successful transfer of the human germ-line antibody gene array into such germ-line mutant mice results in the production of human antibodies upon antigen challenge. Antibodies having the desired activity are selected using Env-CD4-co-receptor complexes as described herein.

(3) Humanized Antibodies

Antibody humanization techniques generally involve the use of recombinant DNA technology to manipulate the DNA sequence encoding one or more polypeptide chains of an antibody molecule. Accordingly, a humanized form of a non-human antibody (or a fragment thereof) is a chimeric antibody or antibody chain (or a fragment thereof, such as an Fv, Fab, Fab', or other antigen-binding portion of an antibody) which contains a portion of an antigen binding site from a non-human (donor) antibody integrated into the framework of a human (recipient) antibody.

To generate a humanized antibody, residues from one or more complementarity determining regions (CDRs) of a recipient (human) antibody molecule are replaced by residues from one or more CDRs of a donor (non-human) antibody molecule that is known to have desired antigen binding characteristics (e.g., a certain level of specificity and affinity for the target antigen). In some instances, Fv framework (FR) residues of the human antibody are replaced by corresponding non-human residues. Humanized antibodies may also contain residues which are found neither in the recipient antibody nor in the imported CDR or framework sequences. Generally, a humanized antibody has one or more amino acid residues introduced into it from a source which is non-human. In practice, humanized antibodies are typically human antibodies in which some CDR residues and possibly some FR residues are substituted by residues from analogous sites in rodent antibodies. Humanized antibodies generally contain at least a portion of an antibody constant region (Fc), typically that of a human antibody (Jones et al., *Nature,* 321:522-525 (1986), Reichmann et al., *Nature,* 332:323-327 (1988), and Presta, *Curr. Opin. Struct. Biol.,* 2:593-596 (1992)).

Methods for humanizing non-human antibodies are well known in the art. For example, humanized antibodies can be generated according to the methods of Winter and co-workers (Jones et al., *Nature,* 321:522-525 (1986), Riechmann et al., *Nature,* 332:323-327 (1988), Verhoeyen et al., *Science,* 239:1534-1536 (1988)), by substituting rodent CDRs or CDR sequences for the corresponding sequences of a human antibody. Methods that can be used to produce humanized antibodies are also described in U.S. Pat. No. 4,816,567 (Cabilly et al.), U.S. Pat. No. 5,565,332 (Hoogenboom et al.), U.S. Pat. No. 5,721,367 (Kay et al.), U.S. Pat. No. 5,837,243 (Deo et al.), U.S. Pat. No. 5,939,598 (Kucherlapati et al.), U.S. Pat. No. 6,130,364 (Jakobovits et al.), and U.S. Pat. No. 6,180,377 (Morgan et al.).

(4) Administration of Antibodies

Administration of the antibodies can be done as disclosed herein. Nucleic acid approaches for antibody delivery also exist. FVIII inhibitor antibody neutralizing antibodies and antibody fragments can also be administered to patients or subjects as a nucleic acid preparation (e.g., DNA or RNA) that encodes the antibody or antibody fragment, such that the patient's or subject's own cells take up the nucleic acid and produce and secrete the encoded antibody or antibody fragment. The delivery of the nucleic acid can be by any means, as disclosed herein, for example.

7. Pharmaceutical Carriers/Delivery of Pharmaceutical Products

As described above, the compositions can also be administered in vivo in a pharmaceutically acceptable carrier. By "pharmaceutically acceptable" is meant a material that is not biologically or otherwise undesirable, i.e., the material may be administered to a subject, along with the nucleic acid or vector, without causing any undesirable biological effects or interacting in a deleterious manner with any of the other components of the pharmaceutical composition in which it is contained. The carrier would naturally be selected to minimize any degradation of the active ingredient and to minimize any adverse side effects in the subject, as would be well known to one of skill in the art.

The compositions may be administered orally, parenterally (e.g., intravenously), by intramuscular injection, by intraperitoneal injection, transdermally, extracorporeally, topically or the like, including topical intranasal administration or administration by inhalant. As used herein, "topical intranasal administration" means delivery of the compositions into the nose and nasal passages through one or both of the nares and can comprise delivery by a spraying mechanism or droplet mechanism, or through aerosolization of the nucleic acid or vector. Administration of the compositions by inhalant can be through the nose or mouth via delivery by a spraying or droplet mechanism. Delivery can also be directly to any area of the respiratory system (e.g., lungs) via intubation. The exact amount of the compositions required will vary from subject to subject, depending on the species, age, weight and general condition of the subject, the severity of the allergic disorder being treated, the particular nucleic acid or vector used, its mode of administration and the like. Thus, it is not possible to specify an exact amount for every composition. However, an appropriate amount can be determined by one of ordinary skill in the art using only routine experimentation given the teachings herein.

Parenteral administration of the composition, if used, is generally characterized by injection. Injectables can be prepared in conventional forms, either as liquid solutions or suspensions, solid forms suitable for solution of suspension in liquid prior to injection, or as emulsions. A more recently revised approach for parenteral administration involves use of a slow release or sustained release system such that a constant dosage is maintained. See, e.g., U.S. Pat. No. 3,610,795, which is incorporated by reference herein.

The materials may be in solution, suspension (for example, incorporated into microparticles, liposomes, or cells). These may be targeted to a particular cell type via antibodies, receptors, or receptor ligands. The following references are examples of the use of this technology to target specific proteins to tumor tissue (Senter, et al., *Bioconjugate Chem.*, 2:447-451, (1991); Bagshawe, K. D., *Br. J. Cancer*, 60:275-281, (1989); Bagshawe, et al., *Br. J. Cancer*, 58:700-703, (1988); Senter, et al., *Bioconjugate Chem.*, 4:3-9, (1993); Battelli, et al., *Cancer Immunol. Immunother.*, 35:421-425, (1992); Pietersz and McKenzie, *Immunolog. Reviews*, 129:57-80, (1992); and Roffler, et al., *Biochem. Pharmacol*, 42:2062-2065, (1991)). Vehicles such as "stealth" and other antibody conjugated liposomes (including lipid mediated drug targeting to colonic carcinoma), receptor mediated targeting of DNA through cell specific ligands, lymphocyte directed tumor targeting, and highly specific therapeutic retroviral targeting of murine glioma cells in vivo. The following references are examples of the use of this technology to target specific proteins to tumor tissue (Hughes et al., *Cancer Research*, 49:6214-6220, (1989); and Litzinger and Huang, *Biochimica et Biophysica Acta*, 1104:179-187, (1992)). In general, receptors are involved in pathways of endocytosis, either constitutive or ligand induced. These receptors cluster in clathrin-coated pits, enter the cell via clathrin-coated vesicles, pass through an acidified endosome in which the receptors are sorted, and then either recycle to the cell surface, become stored intracellularly, or are degraded in lysosomes. The internalization pathways serve a variety of functions, such as nutrient uptake, removal of activated proteins, clearance of macromolecules, opportunistic entry of viruses and toxins, dissociation and degradation of ligand, and receptor-level regulation. Many receptors follow more than one intracellular pathway, depending on the cell type, receptor concentration, type of ligand, ligand valency, and ligand concentration. Molecular and cellular mechanisms of receptor-mediated endocytosis has been reviewed (Brown and Greene, *DNA and Cell Biology* 10:6, 399-409 (1991)).

a) Pharmaceutically Acceptable Carriers

The compositions, including antibodies, can be used therapeutically in combination with a pharmaceutically acceptable carrier.

Suitable carriers and their formulations are described in *Remington: The Science and Practice of Pharmacy* (19th ed.) ed. A. R. Gennaro, Mack Publishing Company, Easton, Pa. 1995. Typically, an appropriate amount of a pharmaceutically-acceptable salt is used in the formulation to render the formulation isotonic. Examples of the pharmaceutically-acceptable carrier include, but are not limited to, saline, Ringer's solution and dextrose solution. The pH of the solution is preferably from about 5 to about 8, and more preferably from about 7 to about 7.5. Further carriers include sustained release preparations such as semipermeable matrices of solid hydrophobic polymers containing the antibody, which matrices are in the form of shaped articles, e.g., films, liposomes or microparticles. It will be apparent to those persons skilled in the art that certain carriers may be more preferable depending upon, for instance, the route of administration and concentration of composition being administered.

Pharmaceutical carriers are known to those skilled in the art. These most typically would be standard carriers for administration of drugs to humans, including solutions such as sterile water, saline, and buffered solutions at physiological pH. The compositions can be administered intramuscularly or subcutaneously. Other compounds will be administered according to standard procedures used by those skilled in the art.

Pharmaceutical compositions may include carriers, thickeners, diluents, buffers, preservatives, surface active agents and the like in addition to the molecule of choice. Pharmaceutical compositions may also include one or more active ingredients such as antimicrobial agents, antiinflammatory agents, anesthetics, and the like.

The pharmaceutical composition may be administered in a number of ways depending on whether local or systemic treatment is desired, and on the area to be treated. Administration may be parenterally, for example by intravenous drip, subcutaneous, intraperitoneal or intramuscular injection. The disclosed antibodies can be administered intravenously, intraperitoneally, intramuscularly, subcutaneouslyor intracavity.

Preparations for parenteral administration include sterile aqueous or non-aqueous solutions, suspensions, and emulsions. Examples of non-aqueous solvents are propylene glycol, polyethylene glycol, vegetable oils such as olive oil, and injectable 30 organic esters such as ethyl oleate. Aqueous carriers include water, alcoholic/aqueous solutions, emulsions or suspensions, including saline and buffered media. Parenteral vehicles include sodium chloride solution, Ringer's dextrose, dextrose and sodium chloride, lactated Ringer's, or fixed oils. Intravenous vehicles include fluid and nutrient replenishers, electrolyte replenishers (such as those based on Ringer's dextrose), and the like. Preservatives and other additives may also be present such as, for example, antimicrobials, anti-oxidants, chelating agents, and inert gases and the like.

Some of the compositions may potentially be administered as a pharmaceutically acceptable acid- or base-addition salt, formed by reaction with inorganic acids such as hydrochloric acid, hydrobromic acid, perchloric acid, nitric acid, thiocyanic acid, sulfuric acid, and phosphoric acid, and organic acids such as formic acid, acetic acid, propionic acid, glycolic acid, lactic acid, pyruvic acid, oxalic acid, malonic acid, succinic acid, maleic acid, and fumaric acid, or by reaction with an inorganic base such as sodium hydroxide, ammonium hydroxide, potassium hydroxide, and organic bases such as mono-, di-, trialkyl and aryl amines and substituted ethanolamines.

8. Chips and Micro Arrays

Disclosed are chips where at least one address is the sequences or part of the sequences set forth in any of the nucleic acid sequences disclosed herein. Also disclosed are chips where at least one address is the sequences or portion of sequences set forth in any of the peptide sequences disclosed herein.

Also disclosed are chips where at least one address is a variant of the sequences or part of the sequences set forth in any of the nucleic acid sequences disclosed herein. Also disclosed are chips where at least one address is a variant of the sequences or portion of sequences set forth in any of the peptide sequences disclosed herein.

9. Computer Readable Mediums

It is understood that the disclosed nucleic acids and proteins can be represented as a sequence consisting of the nucleotides of amino acids. There are a variety of ways to display these sequences, for example the nucleotide guanosine can be represented by G or g. Likewise the amino acid valine can be represented by Val or V. Those of skill in the art understand how to display and express any nucleic acid or protein sequence in any of the variety of ways that exist, each of which is considered herein disclosed. Specifically contemplated herein is the display of these sequences on computer readable mediums, such as, commercially available floppy disks, tapes, chips, hard drives, compact disks, and video disks, or other computer readable mediums. Also disclosed are the binary code representations of the disclosed sequences. Those of skill in the art understand what computer readable mediums. Thus, computer readable mediums on which the nucleic acids or protein sequences are recorded, stored, or saved.

Disclosed are computer readable mediums comprising the sequences and information regarding the sequences set forth herein. Various computational methods can be implemented to determine the haplotype of a sequene. Disclosed herein are computational methods for determining whether a sequence is H1, H2, H3, H4, H5, or H6. Current sequencing technology can determine haplotypes with tedious and costly experiments. Such restriction makes in silico haplotyping attractive. Many inference and statistical methods have been proposed for haplotyping, such as Clark method (Clark, A. G. (1990) Inference of haplotypes from PCR-amplified samples of diploid populations. Molecular Biology and Evolution, 7, 111-122.), parsimony approaches (Gusfield, D. (2001) Inference of haplotypes from samples of diploid populations: Complexity and algorithms Journal of Computational Biology, 8, 305-324; Lancia, G., Bafna, V., Istrail, S., Lippert, R. and R. Schwartz. (2001) SNPs problems, complexity and algorithms. In Proceedings of Annual European Symposium on Algorithms (ESA), 2161, Lecture Notes in Computer Science, 182-193, Springer.; Wang, R., Wu, L., Li, Z., Zhang, X. (2005) Haplotype Reconstruction from SNP Fragments by Minimum Error Correction. Bioinformatics, 21, 2456-2462.), maximum-likelihood methods (Excoffier, L. and Slatkin, M. (1995) Maximum-likelihood estimation of molecular haplotype frequencies in a diploid population. Mol. Biol. Evol., 12, 921-927; Hawley, M. and Kidd, K. (1995) Haplo: a program using the EM algorithm to estimate the frequencies of multi-site haplotypes. J. Heredity, 86, 409-411.), phylogeny-based approaches (Gusfield, D. (2002) Haplotyping as perfect phylogeny: Conceptual framework and efficient solutions. Proceedings of RECOMB 2002: The sixth Annual International Conference on Computational Biology, 166-175; Chung, R. H. and Gusfield, D. (2003) Perfect phylogeny haplotyper: Haplotype inferral using a tree model. Bioinformatics, 19, 780-781; Halperin, E and Eskin, E. (2004) Haplotype reconstruction from genotype data using imperfect phylogeny. Bioinformatics, 20, 1842-1849.), and Bayesian methods (Stephens, M., Smith, N. J. and Donnelly, P. (2001) A new statistical method for haplotype reconstruction from population data. American Journal of Human Genetics, 68, 978-989; Niu, T., Quin, Z. S, Xu, X. and Liu, J. S. (2002) Bayesian haplotype inference for multiple linked single-nucleotide polymorphisms. American Journal of Human Genetics, 70, 157-169). In particular, the parsimony criterion that seeks the minimum number of haplotypes to explain a given set of genotypes, has been widely investigated due to its intuitive simplicity and biological implication. Recently both Wang et al. (Wang, L. S. and Xu, Y. (2003) Haplotype inference by maximum parsimony. Bioinformatics, 19, 1773-1780) and Brown et al. (Wang, L. S. and Xu, Y. (2003) Haplotype inference by maximum parsimony. Bioinformatics, 19, 1773-1780.) developed an exact algorithm to solve the haplotype inference problem based on the parsimony condition, by the branch-and-bound method and by integer programming method respectively. However, the pure parsimony haplotype inference problem is NP-hard (Gusfield, D. (2001) Inference of haplotypes from samples of diploid populations: Complexity and algorithms. Journal of Computational Biology, 8, 305-324).

10. Kits

Disclosed herein are kits that are drawn to reagents that can be used in practicing the methods disclosed herein. The kits can include any reagent or combination of reagent discussed herein or that would be understood to be required or beneficial in the practice of the disclosed methods. For example, the kits could include primers to perform the amplification reactions discussed in certain embodiments of the methods, as well as the buffers and enzymes required to use the primers as intended. For example, disclosed is a kit for determining a subject's FVIII haplotype, comprising the oligonucleotides described herein.

11. Blood Plasma Products

Human blood plasma is the yellow, protein-rich fluid that suspends the cellular components of whole blood, that is, the red blood cells, white blood cells and platelets. Plasma enables many housekeeping and other specialized bodily functions. In blood plasma, the most prevalent protein is albumin, approximately 32 to 35 grams per liter, which helps to maintain osmotic balance of the blood.

Blood plasma is generally accumulated in two ways: plasma separated from donor collected whole blood, and from donated plasma, a process where whole blood is drawn from a donor, the plasma is separated (Plasmapheresis) and then the remainder, less the plasma, is returned to the donor. The human body completely replaces the lost plasma in a matter of days. FVIII products that are from plasma obtained through Plasmapheresis are said to be derived from source plasma FVIII products that are from plasma obtained originally from whole blood units (via whole blood donation), are said to be derived from salvage or recovered plasma.

Blood plasma, once separated from the other components of whole blood, can be further separated into a number of blood plasma products. The process by which plasma is separated into some of its different component parts is known as fractionation. Plasma-derived products are manufactured from batches of blood plasma collected from many thousands of blood donors. The processing of one pooled lot of plasma can take up to six months and, because of concerns about infectious agents, by rule, the process begins with a 90-day quarantine period. Unlike cellular blood components, blood products derived from plasma can be treated with chemicals, heat, ultraviolet radiation or filtration to decrease cost and to increase ease of handling and distribution, and to increase the safety of the blood supply. Each of these methods has some drawbacks: they may leave unsafe levels of some viruses, be very costly, and/or damage the blood or blood plasma.

Quantified and defined by volume, albumin continues to be the main product of the blood plasma fractionation industry. Though there are many uses, its principal use is in restoring blood volume in a wide variety of critical care settings.

Rather than using whole blood transfusions, individual blood components such as red cells, white cells, platelets, and plasma are increasingly being used. Plasma is fractionated into an increasing number of blood plasma products, including albumin, gamma globulins, blood-typing sera, clotting factors (such as FVIII) for people with hemophilia, and more.

Immunoglobins constitute an important class of blood plasma products. This is a group of antibodies made by the body as part of its immune response "team." These products generally confer immediate, though temporary, protection either from a specific agent, such as rabies virus or snake venom, or arising from a non-specific threat such as in cases where an individual's immune system is weakened due to serious illness or medical treatment which may have an adverse effect on the patient.

Two main groups of immunoglobins are produced intravenous Immunoglobin (IVIG)—A highly heterogeneous product that can provide generalized immunity by relying on the inherent variation among individuals and the variety of immune-provoking agents to which they have been exposed over their lifetimes. IVIG is made from plasma collected and pooled from thousands of donors, hyperimmunes—Specific immunoglobins isolated and purified from selected donors who have strong immunity to a selected agent. For example, individuals who have been exposed to rabies vaccine can develop high levels of antibodies to the virus Immunoglobins prepared from such plasma can be used as a first treatment when a person has been bitten by a suspected rabid animal.

The best known of the blood plasma products are the blood clotting factors, necessary for the wellbeing of those with hemophilia. These can be derived from donated blood plasma and administered to individuals who are genetically unable to produce all of the components necessary for blood clotting. The most commonly known need is for Factor VIII.

This pooling of donated blood plasma is made necessary by a new technique that substantially reduces costs and potentially facilitates an easier purifying of the plasma product. The "detergent cleansing" process is not cost effective in small batches.

The New York Blood Center developed this solvent-detergent technology, cleansers that dissolve the fatty coating of viruses such as some HIV, hepatitis B and hepatitis C, some of the so-called lipid-enveloped viruses. It then washes them out of the treated batch.

This process has been used in drugs made from blood plasma, such as immune globulin or hemophiliacs' clotting factor.

Plasma pooling facilitates the treatment, for purposes of economies of scale, handling, distribution and blood safety, of collected blood plasma. This collected and aggregated blood plasma is placed in a common vat for this process. The process, produces what is known as Solvent Detergent Blood Plasma (SD plasma, PLAS+SD). SD blood plasma is a blood product that has undergone treatment with the solvent tri-N-butyl phosphate (TNBP) and the detergent Triton X-100 to destroy any lipid bound viruses including: HIV1 and 2, HCV, HBV and HTLVI and II. The process does not destroy non-enveloped viruses such as parvovirus, hepatitis A virus, or any of the prion particles. The SD process includes the pooling of up to 500,000 units of thawed Fresh Frozen Blood Plasma (FFP), treating it with the solvent and detergent. The treated blood plasma pool is then sterile filtered (and thus leukocyte-reduced) before being repackaged into 200 mL aliquots or bags and re-frozen. This separation into smaller units is to facilitate handling, distribution and use by the transfusion recipient or the blood product reprocessor. SD Blood plasma can be stored for up to one year frozen at −18° C. When ordered for transfusion it is thawed in a water bath to a use temperature of 37° C., which takes approximately 25 to 30 minutes and can be kept refrigerated for up to 24 hours at 1° to 6° centigrade. Only ABO identical or compatible SD Blood plasma can be transfused.

Factor VIII concentrates are a commercially prepared, lyophilized powder purified from human plasma to treat patients with hemostatic disorders such as, hemophilia A or von Willebrand's disease. Alternatively, recombinant (synthetic) protein is purified from genetically engineered non-human cells grown in tissue culture. One factor VIII concentrate unit equals the clotting activity in 1 ml of fresh plasma. Factor VIII concentrate is cell free and is administered without regard to patient or donor ABO or Rh type. It is heat treated and/or solvent detergent treated to reduce the risk of virus transmission. Current processes have eliminated the risk of HIV, HBV and HCV transmission. Concentrates differ in the purification procedures. Highly purified factor VIII, e.g., preparations purified over a monoclonal antibody column or current recombinant factor VIII concentrates, are stabilized by adding 98% of pasteurized human albumin. Porcine factor VIII concentrate is available for patients with high titer anti-human factor VIII 'allo' or autoantibody inhibitors. Factor VIII concentrates are stored refrigerated at 35° to 45° Fahrenheit for up to two years from the date of manufacture. Some preparations may be kept at room temperature for extended periods. Factor VIII concentrate should be infused within four hours of preparation to reduce the risk of bacterial growth. Vials are usually shipped to a hospital pharmacy, Blood service or nursing unit and mixed there prior to use. Many patients or families receive them directly for home care. Methods for purifying FVIII complex from an impure protein fraction are disclosed in U.S. Pat. No. 5,659,017, incorporated herein by reference.

Factor VIII concentrate is indicated for the treatment of bleeding or imminent invasive procedures in patients with hemophilia A, (congenital factor VIII deficiency) and for patients with low titer factor VIII inhibitors. Regular prophylactic doses are often used, as well as daily doses in some hemophilic inhibitor patients to try to induce immune tolerance. Patients with von Willebrand's disease respond to one specific, pasteurized intermediate purity concentrate in which that factor activity is relatively preserved.

Dosage is dependent on the nature of the injury, the degree of factor deficiency, the weight of the patient and the presence and level or absence of factor VIII inhibitors. The half life of circulating factor VIII is eight to twelve hours, therefore transfusions may need to be repeated every 12 to 24 hours to maintain hemostatic levels. Following surgery, it is necessary to maintain hemostatic levels for up to two weeks to prevent delayed bleeding and promote wound healing in the hemophilic patient.

Herein described are any combination and permuation of haplotypes together such as H1 with any combination of H2-H3-H4-H5-H6, H2 with any combination of H1-H3-H4-H5-H6, H3 with any combination of H1-H2-H4-H5-H6, H4 with any combination of H1-H2-H3-H5-H6, H5 with any combination of H1-H2-H3-H5-H6, and H6 with any combination of H1-H2-H3-H4-H5. For example, combinations can include, but are not limited to, H1-H2, H1-H2-H3, H1-H2-H3-H4, H1-H2-H3-H4-H5, H1-H2-H3-H4-H5-H6, H2-H3, H2-H3-H4, H2-H3-H4-H5, H2-H3-H4-H5-H6, H3-H4, H3-H4-H5, H3-H4-H5-H6, H4-H5, H4-H5-H6, H5-H6, H1-H3, H1-H4, H1-H5, H2-H4, H2-H5, H2-H6, H3-H5, H3-H6, H4-H6, and the like.

This applies to individuals/subjects that may be heterozygous and have any combination of haplotypes or wherein pooled blood products can comprise any of the described combinations and permutations.

D. Methods of Making the Compositions

The compositions disclosed herein and the compositions necessary to perform the disclosed methods can be made using any method known to those of skill in the art for that particular reagent or compound unless otherwise specifically noted.

Recombinant factor VIII can be produced through the use of eukaryotic protein expression systems. In general, a eukaryotic cell line, which is deficient in a required gene, is transformed with a vector comprising the gene that it has a deficiency for, and the recombinant DNA which one wishes to express. Transformation can be accomplished by techniques such as electroporation or viral delivery. The cell line chosen to produce the protein is selected to be compatible with the protein of interest, capable of continuously expressing the protein of interests, capable of growing on a medium which facilitates purification of the protein of interest, along with other factors known to those skilled in the art. Examples of such techniques are disclosed in European Patent Application 0 302 968 A2 and U.S. Pat. No. 5,149,637 both of which are incorporated by reference in their entirety.

The recombinant factor VIII molecules can be tested in humans for their reduced antigenicity and/or immunogenicity in at least two types of clinical trials. In one type of trial, designed to determine whether the recombinant or recombinant hybrid factor VIII is immunoreactive with inhibitory antibodies, recombinant or recombinant hybrid factor VIII is administered, preferably by intravenous infusion, to approximately 25 patients having factor VIII deficiency who have antibodies to factor VIII that inhibit the coagulant activity of therapeutic human or porcine factor VIII. The dosage of the recombinant or recombinant hybrid factor VIII is in a range between 5 and 50 Units/kg body weight, preferably 10-50 Units/kg, and most preferably 40 Units/kg body weight. Approximately 1 hour after each administration, the recovery of factor VIII from blood samples is measured in a one-stage coagulation assay. Samples are taken again approximately 5 hours after infusion, and recovery is measured. Total recovery and the rate of disappearance of factor VIII from the samples is predictive of the antibody titer and inhibitory activity. If the antibody titer is high, factor VIII recovery usually cannot be measured. The recovery results are compared to the recovery of recovery results in patients treated with plasma-derived human factor VIII, recombinant human factor VIII, porcine factor VIII, and other commonly used therapeutic forms of factor VIII or factor VIII substitutes.

In a second type of clinical trial, designed to determine whether the recombinant or recombinant hybrid factor VIII is immunogenic, i.e., whether patients will develop inhibitory antibodies, recombinant or recombinant hybrid factor VIII is administered, as described in the preceding paragraph, to approximately 100 previously untreated hemophiliac patients who have not developed antibodies to factor VIII. Treatments are given approximately every 2 weeks over a period of 6 months to 1 year. At 1 to 3 month intervals during this period, blood samples are drawn and Bethesda assays or other antibody assays are performed to determine the presence of inhibitory antibodies. Recovery assays can also be done, after each infusion. Results are compared to hemophiliac patients who receive plasma-derived human factor VIII, recombinant human factor VIII, porcine factor VIII, or other commonly used therapeutic forms of factor VIII or factor VII substitutes.

1. Nucleic Acid Synthesis

For example, the nucleic acids, such as, the oligonucleotides to be used as primers can be made using standard chemical synthesis methods or can be produced using enzymatic methods or any other known method. Such methods can range from standard enzymatic digestion followed by nucleotide fragment isolation (see for example, Sambrook et al., *Molecular Cloning: A Laboratory Manual,* 2nd Edition (Cold Spring Harbor Laboratory Press, Cold Spring Harbor, N.Y., 1989) Chapters 5, 6) to purely synthetic methods, for example, by the cyanoethyl phosphoramidite method using a Milligen or Beckman System 1Plus DNA synthesizer (for example, Model 8700 automated synthesizer of Milligen-Biosearch, Burlington, Mass. or ABI Model 380B). Synthetic methods useful for making oligonucleotides are also described by Ikuta et al., *Ann. Rev. Biochem.* 53:323-356 (1984), (phosphotriester and phosphite-triester methods), and Narang et al., *Methods Enzymol.,* 65:610-620 (1980), (phosphotriester method). Protein nucleic acid molecules can be made using known methods such as those described by Nielsen et al., *Bioconjug. Chem.* 5:3-7 (1994).

2. Peptide Synthesis

One method of producing the disclosed proteins, such as SEQ ID NO: 19, is to link two or more peptides or polypeptides together by protein chemistry techniques. For example, peptides or polypeptides can be chemically synthesized using currently available laboratory equipment using either Fmoc (9-fluorenylmethyloxycarbonyl) or Boc (tert.-butyloxycarbonoyl) chemistry. (Applied Biosystems, Inc., Foster City, Calif.). One skilled in the art can readily appreciate that a peptide or polypeptide corresponding to the disclosed proteins, for example, can be synthesized by standard chemical reactions. For example, a peptide or polypeptide can be synthesized and not cleaved from its synthesis resin whereas the other fragment of a peptide or protein can be synthesized and subsequently cleaved from the resin, thereby exposing a terminal group which is functionally blocked on the other fragment. By peptide condensation reactions, these two fragments can be covalently joined via a peptide bond at their carboxyl and amino termini, respectively, to form an antibody, or fragment thereof. (Grant G A (1992) Synthetic Peptides: A User Guide. W.H. Freeman and Co., N.Y. (1992); Bodansky M and Trost B., Ed. (1993) Principles of Peptide Synthesis. Springer-Verlag Inc., NY (which is herein incorporated by reference at least for material related to peptide synthesis). Alternatively, the peptide or polypeptide is independently synthesized in vivo as described herein. Once isolated, these independent peptides or polypeptides may be linked to form a peptide or fragment thereof via similar peptide condensation reactions.

For example, enzymatic ligation of cloned or synthetic peptide segments allow relatively short peptide fragments to be joined to produce larger peptide fragments, polypeptides or whole protein domains (Abrahmsen L et al., Biochemistry, 30:4151 (1991)). Alternatively, native chemical ligation of synthetic peptides can be utilized to synthetically construct large peptides or polypeptides from shorter peptide fragments. This method consists of a two step chemical reaction (Dawson et al. Synthesis of Proteins by Native Chemical Ligation. Science, 266:776-779 (1994)). The first step is the chemoselective reaction of an unprotected synthetic peptide-thioester with another unprotected peptide segment containing an amino-terminal Cys residue to give a thioester-linked intermediate as the initial covalent product. Without a change in the reaction conditions, this intermediate undergoes spontaneous, rapid intramolecular reaction to form a native peptide bond at the ligation site (Baggiolini M et al. (1992) FEBS Lett. 307:97-101; Clark-Lewis I et al., J. Biol. Chem., 269:16075 (1994); Clark-Lewis I et al., Biochemistry, 30:3128 (1991); Rajarathnam K et al., Biochemistry 33:6623-30 (1994)).

Alternatively, unprotected peptide segments are chemically linked where the bond formed between the peptide segments as a result of the chemical ligation is an unnatural (non-peptide) bond (Schnolzer, M et al. Science, 256:221 (1992)). This technique has been used to synthesize analogs of protein domains as well as large amounts of relatively pure proteins with full biological activity (deLisle Milton R C et al., Techniques in Protein Chemistry IV. Academic Press, New York, pp. 257-267 (1992)).

3. Process or Making the Compositions

Disclosed are processes for making the compositions as well as making the intermediates leading to the compositions There are a variety of methods that can be used for making these compositions, such as synthetic chemical methods and standard molecular biology methods. It is understood that the methods of making these and the other disclosed compositions are specifically disclosed.

Disclosed are nucleic acid molecules produced by the process comprising linking in an operative way a nucleic acid comprising the sequences set forth herein and a sequence controlling the expression of the nucleic acid.

Also disclosed are nucleic acid molecules produced by the process comprising linking in an operative way a nucleic acid molecule comprising a sequence having 80% identity to a sequence set forth in herein, and a sequence controlling the expression of the nucleic acid.

Disclosed are nucleic acid molecules produced by the process comprising linking in an operative way a nucleic acid molecule comprising a sequence that hybridizes under stringent hybridization conditions to a sequence set forth herein and a sequence controlling the expression of the nucleic acid.

Disclosed are nucleic acid molecules produced by the process comprising linking in an operative way a nucleic acid molecule comprising a sequence encoding a peptide set forth herein and a sequence controlling an expression of the nucleic acid molecule.

Disclosed are cells produced by the process of transforming the cell with any of the disclosed nucleic acids. Disclosed are cells produced by the process of transforming the cell with any of the non-naturally occurring disclosed nucleic acids.

Disclosed are any of the disclosed peptides produced by the process of expressing any of the disclosed nucleic acids. Disclosed are any of the non-naturally occurring disclosed peptides produced by the process of expressing any of the disclosed nucleic acids. Disclosed are any of the disclosed peptides produced by the process of expressing any of the non-naturally disclosed nucleic acids.

Disclosed are animals produced by the process of transfecting a cell within the animal with any of the nucleic acid molecules disclosed herein. Disclosed are animals produced by the process of transfecting a cell within the animal any of the nucleic acid molecules disclosed herein, wherein the animal is a mammal. Also disclosed are animals produced by the process of transfecting a cell within the animal any of the nucleic acid molecules disclosed herein, wherein the mammal is mouse, rat, rabbit, cow, sheep, pig, or primate.

Also disclosed are animals produced by the process of adding to the animal any of the sequences disclosed herein.

E. Methods of Using the Compositions

In one embodiment, provided are common allelic variants (e.g. haplotypes) of the human factor (F)VIII protein as pharmacogenetic determinants that modulate the immunogenicity of wildtype (wt) FVIII replacement proteins, the risk of FVIII inhibitor development and the clinical efficacy of transfusion- and gene-delivery-based coagulation factor replacement therapies.

Figure 6:
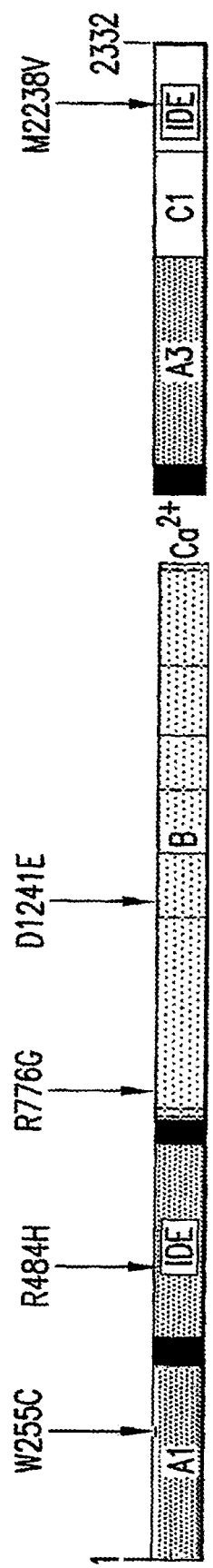
FIG. 6 is a schematic representation of common non-hemophilic F8 nsSNPs indicative of thrombosis susceptibility.

In another embodiment, provided are common allelic variants (e.g. haplotypes) of the human factor (F)VIII protein as pharmacogenetic determinants that modulate thrombosis susceptibility. FIG. 6 is a schematic representation of common non-hemophilic F8 nsSNPs indicative of thrombosis susceptibility.

Disclosed herein are methods capable of determining the FVIII haplotype of an individual with a hemostasis disorder where the hemostasis disorder is thrombophilia (both congenital and acquired).

In a specific embodiment, provided is a haplotype specific Bethesda assay that overcomes the inherent limitations of the common Bethesda assay (i.e., near the cutoff point for this assay, under the conditions in which it is presently performed [with pooled normal plasma, which by definition would represent mostly Caucasian donors and therefore mostly haplotype 1 wildtype form of the human FVIII protein], this assay is known to have both a poor specificity [yields false-positives] and a poor sensitivity [yields false-negatives]) as it is used presently. Provided are methods for making normal plasmas that have only one each of the 6 wildtype forms of the human FVIII protein, so as to minimize the problems associated with false-negatives and false-positives, and to rid any uncertainty about what is the precise make-up of the plasma being used.

In one example, a haplotype-specific ELISA assay that is very similar in principle to the haplotype-specific Bethesda assay, but can detect all antibodies that bind to the different forms of the wildtype FVIII protein, (including those that are functionally neutralizing antibodies called inhibitors and those antibodies that are non-inhibitory [i.e., those that do not inhibit FVIII's function in a clotting assay]), is provided.

Also provided are kits for genotyping a subset of functional FVIII polymorphisms that influence either the circulating levels of FVIII protein or activity, and thereby could aid in more accurate diagnostic risk assessments for the subjects at highest risk for developing venous and/or arterial thrombotic disorders, such as stroke and myocardial infarction. For example, this can apply to the D1241E haplotype, since females who are carrying two copies of the E-allele will have an −25% lower FVIII level than those carrying two major copies of the D-allele and can have an elevated FVIII level.

Also provided are monoclonal antibody-based assays to rapidly "type' the different haplotypic (allelic) forms of the wildtype FVIII protein directly in samples of plasma from patient (in comparison to the DNA-based genotyping assays).

Also provided herein are biological materials, diagnostic materials, and therapeutic materials.

Disclosed is a method of categorizing a haplotype in a FVIII gene comprising, amplifying regions of the FVIII gene, determining a haplotype of the FVIII gene from DNA sequence within the amplified regions, and categorizing the haplotype as being an H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6).

Disclosed is a method of categorizing a haplotype in a FVIII gene comprising, detecting a FVIII protein and categorizing the haplotype of the FVIII gene encoding the detected FVIII protein as being an H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6).

Disclosed is a method of reducing the generation of anti-FVIII antibodies that inhibit or impair FVIII treatment comprising, detecting a haplotype in a FVIII gene in a subject, matching a replacement FVIII therapy to the detected haplotype, and administering the matched replacement FVIII therapy to the subject. The haplotype can be H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6).

Disclosed is a method of preventing the generation of anti-FVIII antibodies that inhibit or impair FVIII treatment comprising, detecting a haplotype in a FVIII gene in a subject, matching a replacement FVIII therapy to the detected haplotype, and administering the matched replacement FVIII therapy to the subject. The haplotype can be H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6).

Disclosed is a method of maximizing efficacy of transfusion therapy in a subject with a hemostatic disorder comprising, determining whether the FVIII haplotype of a subject having a hemostatic disorder is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6) and administering an appropriate transfusion product to the subject based on the results. The transfusion product can be a recombinant FVIII. The transfusion product can be plasma derived FVIII.

Disclosed is a method of administering a blood product to a subject in need of FVIII comprising, obtaining a haplotype in a FVIII gene of a blood product recipient, determining which type of blood product the recipient should receive based on the result, and administering to the subject in need thereof an appropriate blood product. The blood product can be pooled blood plasma derived from more than one blood donor. The blood product can be a plasma-derived FVIII preparation. The pooled blood plasma can be obtained by detecting a haplotype in a FVIII gene of a blood plasma donor and placing the blood plasma of the blood plasma donor in an appropriate FVIII haplotype pool based on the results.

Disclosed is a method of blood plasma pooling comprising, detecting a haplotype in a FVIII gene of a blood plasma donor and placing blood plasma of the blood plasma donor in an appropriate pool based on the results. Disclosed is a pooled blood plasma product obtained through this method.

Disclosed is a method of blood plasma pooling comprising, detecting a haplotype in a FVIII gene of a whole blood donor, receiving whole blood from the whole blood donor, separating plasma from the whole blood, and pooling the plasma with plasma obtained from other donors with a similar haplotype. Disclosed is a pooled blood plasma product obtained through this method.

Disclosed is a method of preparing a plasma-derived FVIII product comprising, determining the haplotype of blood plasma, wherein the haplotype is H1 (SEQ ID NO: 1), H2 (SEQ ID NO: 2), H3 (SEQ ID NO: 3), H4 (SEQ ID NO: 4), 1-15 (SEQ ID NO: 5), or 116 (SEQ ID NO: 6), and preparing a plasma-derived FVIII product from the haplotyped blood plasma wherein the resulting FVIII product is homogenous with respect to FVIII content. Disclosed is a plasma-derived FVIII product obtained through this method.

Disclosed is a method of treating a subject with a hemostatic disorder comprising, identifying a subject with a hemostatic disorder; determining the FVIII haplotype of the subject, wherein the haplotype is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6) and administering an appropriate FVIII gene replacement product to the subject based on the results. The hemostatic disorder can be congenital hemophilia A. The hemostatic disorder can be acquired hemophilia A.

The replacement product given will vary, depending on the condition of the subject. For example, after determining the FVIII haplotype(s) in a patient with acquired hemophilia A, the disclosed Haplotype-Specific Bethesda assay can be used to determine the haplotype(s) against which their antoanti-FVIII antibodies are reactive. If a given patient's inhibitors are directed against only their own endogenous FVIII molecule(s), or react with one or more of the other forms of the wildtype FVIII protein less then with their own, this Bethesda assay can be used to provide them with the most appropriate replacement FVIII product (i.e., the FVIII haplotype least reactive with their serum).

In congenital hemophilia, antibody inhibitors against these proteins are known complications of factor replacement therapy. Therefore, the previously untreated subject can be given replacement products based on their congenital haplotype, thereby maximizing transfusion efficacy in the treatment of these other hemostatic disorders.

As used herein, the term "appropriate" with regard to a transfusion, blood, or gene replacement product refers to an effective, or useful, haplotype, as well as the amount. Those of skill in the art can readily determine an appropriate haplotype based on the methods disclosed herein. Specific dosages and methods of administration are discussed herein as well.

Disclosed is a method of treating a subject with a hemostatic disorder comprising, identifying a subject with a hemostatic disorder, determining the FVIII haplotype of the subject, wherein the haplotype is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6) and administering an appropriate plasma-derived FVIII product to the subject based on the results. The hemostatic disorder can be congenital hemophilia A. The hemostatic disorder can be acquired hemophilia A.

Disclosed is a method of treating a subject with a hemostatic disorder comprising, identifying a subject with a hemostatic disorder, determining the FVIII haplotype of the subject, wherein the haplotype is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6) and administering an appropriate recombinant FVIII product to the subject based on the results. The hemostatic disorder can be congenital hemophilia A. The hemostatic disorder can be acquired hemophilia A.

Disclosed is a method for rapidly diagnosing a FVIII haplotype in a subject, comprising, obtaining a sample from the subject, analyzing the sample using rapid PCR, and determining a FVIII haplotype for the subject. The FVIII haplotype can be selected from the group consisting of H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6). The subject can be diagnosed with congenital hemophilia A. The subject can be diagnosed with acquired hemophilia A.

Disclosed is a method of maximizing the sensitivity and specificity of clinical diagnostic algorithms for identifying a subject with a prothrombotic hemostatic disorder comprising, obtaining a sample from the subject, determining whether the FVIII haplotype of a subject having a hemostatic disorder is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6) and performing the appropriate additional laboratory diagnostic testing on the subject based on the results.

Disclosed is a method of treating a subject with a prothrombotic hemostatic disorder comprising, identifying a subject with a hemostatic disorder, determining the FVIII haplotype of the subject, wherein the haplotype is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6) and administering an appropriate anti-thrombotic prophylactic treatment regimen to the subject based on the results. The hemostatic disorder can be congenital thrombophilia. The hemostatic disorder can be acquired thrombophilia.

Disclosed are antibodies that target high risk haplotypes of FVIII. Disclosed are antibodies that target peptide regions unique to said high risk haplotypes. Disclosed are agents that neutralize the activity of high risk haplotypes. An agent can be, for example, a monoclonal antibody. Disclosed is an antibody to a polypeptide comprising the sequence as set forth in SEQ ID NO: 19. Disclosed is an n antibody to a polypeptide comprising the sequence as set forth in SEQ ID NO: 20. Disclosed is an n antibody to a polypeptide comprising the sequence as set forth in SEQ ID NO: 21. Disclosed is an n antibody to a polypeptide comprising the sequence as set forth in SEQ ID NO: 22. Disclosed is an antibody to a polypeptide comprising the sequence as set forth in SEQ ID NO: 23. Disclosed is an antibody to a polypeptide comprising the sequence as set forth in SEQ ID NO: 24.

Disclosed is a method of treating a subject with a prothrombotic hemostatic disorder comprising, identifying a subject with a prothrombotic hemostatic disorder, determining the FVIII haplotype of the subject, wherein the haplotype is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6) and administering an appropriate anti-thrombotic prophylactic treatment regimen to the subject based on the results. The hemostatic disorder can be congenital hemophilia A. The hemostatic disorder can be acquired hemophilia A.

Disclosed is a method of treating a subject with a hemostatic disorder comprising, identifying a subject with a hemostatic disorder, determining the FVIII haplotype of the subject, wherein the haplotype is H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6), and administering an appropriate recombinant FVIII product to the subject based on the results. The hemostatic disorder can be congenital hemophilia A. The hemostatic disorder can be acquired hemophilia A.

Disclosed is a method for rapidly diagnosing a FVIII haplotype in a subject, comprising, obtaining a sample from the subject, analyzing the sample using rapid PCR, determining a FVIII haplotype for the subject. The FVIII haplotype can be selected from the group consisting of H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6). The subject can be diagnosed with congenital hemophilia A. The subject can be diagnosed with acquired hemophilia A.

Disclosed is a method for rapidly diagnosing a FVIII haplotype in a subject, comprising, obtaining a sample from the subject, analyzing the sample using FVIII haplotype specific antibodies, and determining a FVIII haplotype for the subject. The haplotype can be selected from the group consisting of H1 (SEQ ID NO: 1), H2 (SEQ ID NO: 2), H3 (SEQ ID NO: 3), H4 (SEQ ID NO: 4), H5 (SEQ ID NO: 5), or H6 (SEQ ID NO: 6). The subject can be diagnosed with thrombosis.

Disclosed is a method of screening to determine the presence of alloantibodies of FVIII comprising, administering FVIII of a known haplotype wherein the haplotype is H1 (SEQ ID NO: 1), H2 (SEQ ID NO: 2), H3 (SEQ ID NO: 3), H4 (SEQ ID NO: 4), H5 (SEQ ID NO: 5), H6 (SEQ ID NO: 6), and determining whether alloantibody binding occurs.

Disclosed is an oligonucleotide comprising the sequence as set forth in SEQ ID NO: 1. Disclosed is an oligonucleotide comprising the sequence as set forth in SEQ ID NO: 2. Disclosed is an oligonucleotide comprising the sequence as set forth in SEQ ID NO: 3. Disclosed is an oligonucleotide comprising the sequence as set forth in SEQ ID NO: 4. Disclosed is an oligonucleotide comprising the sequence as set forth in SEQ ID NO: 5. Disclosed is an oligonucleotide comprising the sequence as set forth in SEQ ID NO: 6.

Disclosed is an oligonucleotide comprising a sequence selected from the group consisting of SEQ ID NO:1-12 and 25-124.

Disclosed is a mixture of primers comprising SEQ ID NOS: 25 and 26. Disclosed is a mixture of primers comprising SEQ ID NOS: 29 and 30. Disclosed is a mixture of primers comprising SEQ ID NOS: 33 and 34. Disclosed is a mixture of primers comprising SEQ ID NOS: 37 and 38. Disclosed is a mixture of primers comprising SEQ ID NOS: 25 and 26. Disclosed is a mixture of primers comprising SEQ ID NOS: 41 and 42. Disclosed is a mixture of primers comprising SEQ ID NOS: 43 and 44. Disclosed is a mixture of primers comprising SEQ ID NOS: 45 and 46. Disclosed is a mixture of primers comprising SEQ ID NOS: 47 and 48. Disclosed is a mixture of primers comprising SEQ ID NOS: 49-124.

Disclosed is a polypeptide comprising the sequence as set forth in SEQ ID NO: 13. Disclosed is a polypeptide comprising the sequence as set forth in SEQ ID NO: 14.

Disclosed is a polypeptide comprising the sequence as set forth in SEQ ID NO: 15. Disclosed is a polypeptide comprising the sequence as set forth in SEQ ID NO: 16. Disclosed is a polypeptide comprising the sequence as set forth in SEQ ID NO: 17. Disclosed is a polypeptide comprising the sequence as set forth in SEQ ID NO: 18. Disclosed is a polypeptide comprising the sequence as set forth in SEQ ID NO: 19. Disclosed is a polypeptide comprising the sequence as set forth in SEQ ID NO: 20. Disclosed is a polypeptide comprising the sequence as set forth in SEQ ID NO: 21. Disclosed is a polypeptide comprising the sequence as set forth in SEQ ID NO: 22. Disclosed is a polypeptide comprising the sequence as set forth in SEQ ID NO: 23. Disclosed is a polypeptide comprising the sequence as set forth in SEQ ID NO: 24.

Disclosed is a composition comprising pooled FVIII having a single haplotype. The haplotype can be H1, H2, H3, H4, H5 or H6.

Disclosed is a recombinant FVIII having the H1 haplotype. Disclosed is a recombinant FVIII having the H2 haplotype. Disclosed is a recombinant FVIII having the H3 haplotype. Disclosed is a recombinant FVIII having the H4 haplotype. Disclosed is a recombinant FVIII having the H5 haplotype. Disclosed is a recombinant FVIII having the H6 haplotype.

Methods of manufacturing recombinant FVIII constructs are disclosed in U.S. Pat. Nos. 6,852,537; 6,770,744; 6,759,216; 6,517,830; 6,458,563; 6,376,463; 6,180,371; 5,888,974; 5,859,204; 5,744,446; 5,663,060; 5,583,209; 5,364,771 incorporated herein by reference.

1. Methods of Using the Compositions as Research Tools

The disclosed compositions can be used in a variety of ways as research tools. For example, the disclosed compositions can be used to study the the various haplotypes of FVIII.

The compositions can be used for example as targets in combinatorial chemistry protocols or other screening protocols to isolate molecules that possess desired functional properties related to FVIII.

The disclosed compositions can also be used diagnostic tools related to diseases such as hemophilia and hemostatic disorders, for example.

The disclosed compositions can be used as discussed herein as either reagents in micro arrays or as reagents to probe or analyze existing microarrays. The disclosed compositions can be used in any known method for isolating or identifying single nucleotide polymorphisms. The compositions can also be used in any method for determining allelic analysis of for example, FVIII haplotypes as described herein, particularly allelic analysis as it relates to H1-H6 and their functions. The compositions can also be used in any known method of screening assays, related to chip/micro arrays. The compositions can also be used in any known way of using the computer readable embodiments of the disclosed compositions, for example, to study relatedness or to perform molecular modeling analysis related to the disclosed compositions.

2. Methods of Protein Detection

An alternative to genetic haplotyping is haplotyping a subject based off the protein expressed by their FVIII gene by detecting an FVIII protein associated with a disclosed haplotype. The disclosed proteins, including FVIII proteins in or on any sample, composition or other context, can be detected using any suitable technique. It is important to be able to separate FVIII from other proteins, as well as to separate FVIII subtypes from each other. Further, molecules that interact with or bind to the disclosed proteins, such as antibodies to a protein, can be detected using known techniques. Many suitable techniques—such as techniques generally known for the detection of proteins, peptides and other analytes and antigens—are known, some of which are described below. In general, these techniques can involve direct imaging (e.g., microscopy), immunoassays, or by functional determination. By "functional determination" is meant that a given protein such as a protein that has a function can be detected by the detection of said function. For example, an enzyme can be detected by evaluating its activity on its substrate. The techniques described below are useful in detecting FVIII in a subject, including the various haplotypes described herein, separating FVIII from other proteins, or in separating various haplotypes of FVIII from each other.

a) Immunoassays

Immunodetection methods can be used for detecting, binding, purifying, removing and quantifying various molecules including the disclosed FVIII haplotypes. Further, antibodies and ligands to the disclosed proteins can be detected. For example, the disclosed proteins can be employed to detect antibodies having reactivity therewith. This is useful, for example, to detect whether a subject has been exposed to or has developed antibodies against a protein. Standard immunological techniques are described, e.g., in Hertzenberg, et al., *Weir's Handbook of Experimental Immunology*, vols. 1-4 (1996); Coligan, *Current Protocols in Immunology* (1991); *Methods in Enzymology*, vols. 70, 73, 74, 84, 92, 93, 108, 116, 121, 132, 150, 162, and 163; and Paul, *Fundamental Immunology* (3d ed. 1993) each incorporated herein by reference in its entirety and specifically for its teaching regarding immunodetection methods.

The steps of various useful immunodetection methods have been described in the scientific literature, such as, e.g., Maggio et al., *Enzyme-Immunoassay*, (1987) and Nakamura, et al., *Enzyme Immunoassays: Heterogeneous and Homogeneous Systems, Handbook of Experimental Immunology, Vol.* 1: Immunochemistry, 27.1-27.20 (1986) each incorporated herein by reference in its entirety and specifically for its teaching regarding immunodetection methods Immunoassays, in their most simple and direct sense, are binding assays involving binding between antibodies and antigen. Many types and formats of immunoassays are known and all are suitable for detecting the disclosed proteins. Examples of immunoassays are enzyme linked immunosorbent assays (ELISAs), radioimmunoassays (RIA), radioimmune precipitation assays (RIPA), immunobead capture assays, Western blotting, dot blotting, gel-shift assays, Flow cytometry, protein arrays, multiplexed bead arrays, magnetic capture, in vivo imaging, fluorescence resonance energy transfer (FRET), and fluorescence recovery/localization after photobleaching (FRAP/FLAP).

In general, immunoassays involve contacting a sample suspected of containing a molecule of interest (such as the disclosed proteins) with an antibody to the molecule of interest or contacting an antibody to a molecule of interest (such as antibodies to the disclosed proteins) with a molecule that can be bound by the antibody, as the case may be, under conditions effective to allow the formation of immunocomplexes. Contacting a sample with the antibody to the molecule of interest or with the molecule that can be bound by an antibody to the molecule of interest under conditions effective and for a period of time sufficient to allow the formation of immune complexes (primary immune complexes) is generally a matter of simply bringing into contact the molecule or antibody and the sample and incubating the mixture for a period of time long enough for the antibodies to form immune complexes with, i.e., to bind to, any molecules (e.g. antigens) present to which the antibodies can bind. In many forms of immunoassay, the sample-antibody composition, such as a tissue section, ELISA plate, dot blot or Western blot, can then be washed to remove any non-specifically bound antibody species, allowing only those antibodies specifically bound within the primary immune complexes to be detected.

The sample used can be any sample that is suspected of containing a molecule of interest (or an antibody to a molecule of interest). The sample can be, for example, one or more cells, tissue, or bodily fluids such as blood, urine, semen, lymphatic fluid, cerebrospinal fluid, or amniotic fluid, or other biological samples, such as tissue culture cells, buccal swabs, mouthwash, stool, tissue slices, tissue sections, homogenized tissue extract, cell membrane preparation, biopsy aspiration, archeological samples such as bone or mummified tissue, infection samples, nosocomial infection samples, production samples, drug preparation samples, biological molecule production samples, protein preparation samples, lipid preparation samples, and/or carbohydrate preparation samples, and separated or purified forms of any of the above.

Immunoassays can include methods for detecting or quantifying the amount of a molecule of interest (such as the disclosed proteins or their antibodies) in a sample, which methods generally involve the detection or quantitation of any immune complexes formed during the binding process. In general, the detection of immunocomplex formation is well known in the art and can be achieved through the application of numerous approaches. These methods are generally based upon the detection of a label or marker, such as any radioactive, fluorescent, biological or enzymatic tags or any other known label. See, for example, U.S. Pat. Nos. 3,817,837; 3,850,752; 3,939,350; 3,996,345; 4,277,437; 4,275,149 and 4,366,241, each incorporated herein by reference in its entirety and specifically for its teaching regarding immunodetection methods and labels.

As used herein, a label can include a fluorescent dye, a member of binding pair, such as biotin/streptavidin, a metal (e.g., gold), or an epitope tag that can specifically interact with a molecule that can be detected, such as by producing a colored substrate or fluorescence. Substances suitable for detectably labeling proteins include fluorescent dyes (also known herein as fluorochromes and fluorophores) and enzymes that react with colorometric substrates (e.g., horseradish peroxidase). The use of fluorescent dyes is generally preferred in the practice of the invention as they can be detected at very low amounts. Furthermore, in the case where multiple antigens are reacted with a single array, each antigen can be labeled with a distinct fluorescent compound for simultaneous detection. Labeled spots on the array are detected using a fluorimeter, the presence of a signal indicating an antigen bound to a specific antibody.

Fluorophores are compounds or molecules that luminesce. Typically fluorophores absorb electromagnetic energy at one wavelength and emit electromagnetic energy at a second wavelength. Representative fluorophores include, but are not limited to, 1,5 IAEDANS; 1,8-ANS; 4-Methylumbelliferone; 5-carboxy-2,7-dichlorofluorescein; 5-Carboxyfluorescein (5-FAM); 5-Carboxynapthofluorescein; 5-Carboxytetramethylrhodamine (5-TAMRA); 5-Hydroxy Tryptamine (5-HAT); 5-ROX (carboxy-X-rhodamine); 6-Carboxyrhodamine 6G; 6-CR 6G; 6-JOE; 7-Amino-4-methylcoumarin; 7-Aminoactinomycin D (7-AAD); 7-Hydroxy-4-I methylcoumarin; 9-Amino-6-chloro-2-methoxyacridine (ACMA); ABQ; Acid Fuchsin; Acridine Orange; Acridine Red; Acridine Yellow; Acriflavin; Acriflavin Feulgen SITSA; Aequorin (Photoprotein); AFPs—AutoFluorescent Protein—(Quantum Biotechnologies) see sgGFP, sgBFP; Alexa Fluor 350™ Alexa Fluor 430™ Alexa Fluor 488™ Alexa Fluor 532™; Alexa Fluor 546™ Alexa Fluor 568™; Alexa Fluor 594™ Alexa Fluor 633™; Alexa Fluor 647™; Alexa Fluor 660™ Alexa Fluor 680™ Alizarin Complexon; Alizarin Red; Allophycocyanin (APC); AMC, AMCA-S; Aminomethylcoumarin (AMCA); AMCA-X; Aminoactinomycin D; Aminocoumarin; Anilin Blue; Anthrocyl stearate; APC-Cy7; APTRA-BTC; APTS; Astrazon Brilliant Red 4G; Astrazon Orange R; Astrazon Red 6B; Astrazon Yellow 7 GLL; Atabrine; ATTO-TAG™ CBQCA; ATTO-TAG™ FQ; Auramine; Aurophosphine G; Aurophosphine; BAO 9 (Bisaminophenyloxadiazole); BCECF (high pH); BCECF (low pH); Berberine Sulphate; Beta Lactamase; BFP blue shifted GFP (Y66H); Blue Fluorescent Protein; BFP/GFP FRET; Bimane; Bisbenzemide; Bisbenzimide (Hoechst); bis-BTC; Blancophor FFG; Blancophor SV; BOBO™-1; BOBO™; Bodipy492/515; Bodipy493/503; Bodipy500/510; Bodipy; 505/515; Bodipy 530/550; Bodipy 542/563; Bodipy 558/568; Bodipy 564/570; Bodipy 576/589; Bodipy 581/591; Bodipy 630/650-X; Bodipy 650/665-X; Bodipy 665/676; Bodipy F1; Bodipy FL ATP; Bodipy F1-Ceramide; Bodipy R6G SE; Bodipy TMR; Bodipy TMR-X conjugate; Bodipy TMR-X, SE; Bodipy TR; Bodipy TR ATP; Bodipy TR-X SE; BO-PRO™-1; BO-PRO™-3; Brilliant Sulphoflavin FF; BTC; BTC-5N; Calcein; Calcein Blue; Calcium Crimson-; Calcium Green; Calcium Green-1 $Ca^{2+}$ Dye; Calcium Green-2 $Ca^{2+}$; Calcium Green-5N $Ca^{2+}$; Calcium Green-C 18 $Ca^{2+}$; Calcium Orange; Calcofluor White; Carboxy-X-rhodamine (5-ROX); Cascade Blue™; Cascade Yellow; Catecholamine; CCF2 (GeneBlazer); CFDA; CFP (Cyan Fluorescent Protein); CFP/YFP FRET; Chlorophyll; Chromomycin A; Chromomycin A; CL-NERF; CMFDA; Coelenterazine; Coelenterazine cp; Coelenterazine f; Coelenterazine fcp; Coelenterazine h; Coelenterazine hcp; Coelenterazine ip; Coelenterazine n; Coelenterazine O; Coumarin Phalloidin; C-phycocyanine; CPM I Methylcoumarin; CTC; CTC Formazan; Cy2™; Cy3.1 8; Cy3.5™; Cy3™; Cy5.1 8; Cy5.5™; Cy5™; Cy7™; Cyan GFP; cyclic AMP Fluorosensor (FiCRhR); Dabcyl; Dansyl; Dansyl Amine; Dansyl Cadaverine; Dansyl Chloride; Dansyl DHPE; Dansyl fluoride; DAPI; Dapoxyl; Dapoxyl 2; Dapoxyl 3'DCFDA; DCFH (Dichlorodihydrofluorescein Diacetate); DDAO; DHR (Dihydorhodamine 123); Di-4-ANEPPS; Di-8-ANEPPS (non-ratio); DiA (4-Di 16-ASP); Dichlorodihydrofluorescein Diacetate (DCFH); DiD-Lipophilic Tracer; DiD (DiIC18(5)); DIDS; Dihydrohodamine 123 (DHR); DiI (DiIC18(3)); I Dinitrophenol; DiO (DiOC18(3)); DiR; DiR (DiIC18(7)); DM-NERF (high pH); DNP; Dopamine; DsRed; DTAF; DY-630-NHS; DY-635-NHS; EBFP; ECFP; EGFP; ELF 97; Eosin; Erythrosin; Erythrosin ITC; Ethidium Bromide; Ethidium homodimer-1 (EthD-1); Euchrysin; EukoLight; Europium (111) chloride; EYFP; Fast Blue; FDA; Feulgen (Pararosaniline); FIF (Formaldehyd Induced Fluorescence); FITC; Flazo Orange; Fluo-3; Fluo-4; Fluorescein (FITC); Fluorescein Diacetate; Fluoro-Emerald; Fluoro-Gold (Hydroxystilbamidine); Fluor-Ruby; FluorX; FM 1-43TM; FM 4-46; Fura Red™ (high pH); Fura Red™/Fluo-3; Fura-2; Fura-2/BCECF; Genacryl Brilliant Red B; Genacryl Brilliant Yellow 10GF; Genacryl Pink 3G; Genacryl Yellow 5GF; GeneBlazer; (CCF2); GFP (S65T); GFP red shifted (rsGFP); GFP wild type' non-UV excitation (wtGFP); GFP wild type, UV excitation (wtGFP); GFPuv; Gloxalic Acid; Granular blue; Haematoporphyrin; Hoechst 33258; Hoechst 33342; Hoechst 34580; HPTS; Hydroxycoumarin; Hydroxystilbamidine (FluoroGold); Hydroxytryptamine; Indo-1, high calcium; Indo-1 low calcium; Indodicarbocyanine (DiD); Indotricarbocyanine (DiR); Intrawhite Cf; JC-1; JO JO-1; JO-PRO-1; LaserPro; Laurodan; LDS 751 (DNA); LDS 751 (RNA); Leucophor PAF; Leucophor SF; Leucophor WS; Lissamine Rhodamine; Lissamine Rhodamine B; Calcein/Ethidium homodimer; LOLO-1; LO-PRO-1; Lucifer Yellow; Lyso Tracker Blue; Lyso Tracker Blue-White; Lyso Tracker Green; Lyso Tracker Red; Lyso Tracker Yellow; LysoSensor Blue; LysoSensor Green; LysoSensor Yellow/Blue; Mag Green; Magdala Red (Phloxin B); Mag-Fura Red; Mag-Fura-2; Mag-Fura-5; Mag-lndo-1; Magnesium Green; Magnesium Orange; Malachite Green; Marina Blue; I Maxilon Brilliant Flavin 10 GFF; Maxilon Brilliant Flavin 8 GFF; Merocyanin; Methoxycournarin; Mitotracker Green FM; Mitotracker Orange; Mitotracker Red; Mitramycin; Monobromobimane; Monobromobimane (mBBr-GSH); Monochlorobimane; MPS (Methyl Green Pyronine Stilbene); NBD; NBD Amine; Nile Red; Nitrobenzoxedidole; Noradrenaline; Nuclear Fast Red; i Nuclear Yellow; Nylosan Brilliant lavin E8G; Oregon Green™; Oregon Green™ 488; Oregon Green™ 500; Oregon Green™ 514; Pacific Blue; Pararosaniline (Feulgen); PBFI; PE-Cy5; PE-Cy7; PerCP; PerCP-Cy5.5; PE-TexasRed (Red 613); Phloxin B (Magdala Red); Phorwite AR; Phorwite BKL; Phorwite Rev; Phorwite RPA; Phosphine 3R; PhotoResist; Phycoerythrin B [PE]; Phycoerythrin R [PE]; PKH26 (Sigma); PKH67; PMIA; Pontocluome Blue Black; POPO-1; POPO-3; PO-PRO-1; PO-I PRO-3; Primuline; Procion Yellow; Propidium lodid (P1); PyMPO; Pyrene; Pyronine; Pyronine B; Pyrozal Brilliant Flavin 7GF; QSY 7; Quinacrine Mustard; Resorufin; RH 414; Rhod-2; Rhodamine; Rhodamine 110; Rhodamine 123; Rhodamine 5 GLD; Rhodamine 6G; Rhodamine B; Rhodamine B 200; Rhodamine B extra; Rhodamine BB; Rhodamine BG; Rhodamine Green; Rhodamine Phallicidine; Rhodamine Phalloidine; Rhodamine Red; Rhodamine WT; Rose Bengal; R-phycocyanine; R-phycoerythrin (PE); rsGFP; S65A; S65C; S65L; S65T; Sapphire GFP; SBFI; Serotonin; Sevron Brilliant Red 2B; Sevron Brilliant Red 4G; Sevron I Brilliant Red B; Sevron Orange; Sevron Yellow L; sgBFP™ (super glow BFP); sgGFP™ (super glow GFP); SITS (Primuline; Stilbene Isothiosulphonic Acid); SNAFL calcein; SNAFL-1; SNAFL-2; SNARF calcein; SNARF1; Sodium Green; SpectruniAqua; SpectrumGreen; SpectrumOrange; Spectrum Red; SPQ (6-methoxy-N-(3 sulfopropyl)quinolinium); Stilbene; Sulphorhodamine B and C; Sulphorhodamine Extra; SYTO 11; SYTO 12; SYTO 13; SYTO 14; SYTO 15; SYTO 16; SYTO 17; SYTO 18; SYTO 20; SYTO 21; SYTO 22; SYTO 23; SYTO 24; SYTO 25; SYTO 40; SYTO 41; SYTO 42; SYTO 43; SYTO 44; SYTO 45; SYTO 59; SYTO 60; SYTO 61; SYTO 62; SYTO 63; SYTO 64; SYTO 80; SYTO 81; SYTO 82; SYTO 83; SYTO 84; SYTO 85; SYTOX Blue; SYTOX Green; SYTOX Orange; Tetracycline; Tetramethyirhodamine (TRITC); Texas Red™; Texas Red-X™ conjugate; Thiadicarbocyanine (DiSC3); Thiazine Red R; Thiazole Orange; Thioflavin. 5; Thioflavin S; Thioflavin TON; Thiolyte; Thiozole Orange; Tinopol CBS (Calcofluor White); TIER; TO-PRO-1; TO-PRO-3; TO-PRO-5; TOTO-1; TOTO-3; TriColor (PE-Cy5); TRITC TetramethylRodaminelsoThioCyanate; True Blue; Tru Red; Ultralite; Uranine B; Uvitex SFC; wt GFP; WW 781; X-Rhodamine; XRITC; Xylene Orange; Y66F; Y66H; Y66W; Yellow GFP; YFP; YO-PRO-1; YO-PRO 3; YOYO-1; YOY0-3; Sybr Green; Thiazole orange (interchelating dyes); semiconductor nanoparticles such as quantum dots; or caged fluorophore (which can be activated with light or other electromagnetic energy source), or a combination thereof.

Green flourescent protein (GFP) has become the one of the most popular reporter proteins and as such a nice epitope tag. However, GFP is much larger than most other epitope tags.

Digoxigenin (DIG) is a small organic molecule that can be covalently added to proteins or nucleic acids, which makes it useful in diverse applications.

Biotin is a small molecule that can be covalently linked to proteins after they have been translated. Therefore, unlike most other protein epitope tags, it can be added at any point in time and is often used to label proteins located in particular sites such as on the extracellular surface of cells.

Flourescent dyes, such as those described herein, for which antibodies are available are also commonly used as epitope tags.

Labeling can be either direct or indirect. In direct labeling, the detecting antibody (the antibody for the molecule of interest) or detecting molecule (the molecule that can be bound by an antibody to the molecule of interest) include a label. Detection of the label indicates the presence of the detecting antibody or detecting molecule which in turn indicates the presence of the molecule of interest or of an antibody to the molecule of interest, respectively. In indirect labeling, an additional molecule or moiety is brought into contact with, or generated at the site of, the immunocomplex. For example, a signal-generating molecule or moiety such as an enzyme can be attached to or associated with the detecting antibody or detecting molecule. The signal-generating molecule can then generate a detectable signal at the site of the immunocomplex. For example, an enzyme, when supplied with suitable substrate, can produce a visible or detectable product at the site of the immunocomplex. ELISAs use this type of indirect labeling.

As another example of indirect labeling, an additional molecule (which can be referred to as a binding agent) that can bind to either the molecule of interest or to the antibody to the molecule of interest, such as a second antibody to the molecule of interest, can be contacted with the immunocomplex. The additional molecule can have a label or signal-generating molecule or moiety. The additional molecule can be an antibody, which can thus be termed a secondary antibody. Binding of a secondary antibody to the molecule of interest can form a so-called sandwich with the first (or primary) antibody and the molecule of interest. The immune complexes can be contacted with the labeled, secondary antibody under conditions effective and for a period of time sufficient to allow the formation of secondary immune complexes. The secondary immune complexes can then be generally washed to remove any non-specifically bound labeled secondary antibodies, and the remaining label in the secondary immune complexes can then be detected. The additional molecule can also be or include one of a pair of molecules or moieties that can bind to each other, such as the biotin/avadin pair. In this mode, the detecting antibody or detecting molecule should include the other member of the pair.

Other modes of indirect labeling include the detection of primary immune complexes by a two step approach. For example, a molecule (which can be referred to as a first binding agent), such as an antibody, that has binding affinity for the molecule of interest or corresponding antibody can be used to form secondary immune complexes, as described above. After washing, the secondary immune complexes can be contacted with another molecule (which can be referred to as a second binding agent) that has binding affinity for the first binding agent, again under conditions effective and for a period of time sufficient to allow the formation of immune complexes (thus forming tertiary immune complexes). The second binding agent can be linked to a detectable label or signal-genrating molecule or moiety, allowing detection of the tertiary immune complexes thus formed. This system can provide for signal amplification.

Immunoassays that involve the detection of as substance, such as a protein or an antibody to a specific protein, include label-free assays, protein separation methods (i.e., electrophoresis), solid support capture assays, or in vivo detection. Label-free assays are generally diagnostic means of determining the presence or absence of a specific protein, or an antibody to a specific protein, in a sample. Protein separation methods are additionally 0 useful for evaluating physical properties of the protein, such as size or net charge. Capture assays are generally more useful for quantitatively evaluating the concentration of a specific protein, or antibody to a specific protein, in a sample. Finally, in vivo detection is useful for evaluating the spatial expression patterns of the substance, i.e., where the substance can be found in a subject, tissue or cell.

b) Label-Free Assays

Provided that the concentrations are sufficient, the molecular complexes ([Ab-Ag]n) generated by antibody-antigen interaction are visible to the naked eye, but smaller amounts may also be detected and measured due to their ability to scatter a beam of light. The formation of complexes indicates that both reactants are present, and in immunoprecipitation assays a constant concentration of a reagent antibody is used to measure specific antigen ([Ab-Ag]n), and reagent antigens are used to detect specific antibody ([Ab-Ag]n). If the reagent species is previously coated onto cells (as in hemagglutination assay) or very small particles (as in latex agglutination assay), "clumping" of the coated particles is visible at much lower concentrations. A variety of assays based on these elementary principles are in common use, including Ouchterlony immunodiffusion assay, rocket immunoelectrophoresis, and immunoturbidometric and nephelometric assays. The main limitations of such assays are restricted sensitivity (lower detection limits) in comparison to assays employing labels and, in some cases, the fact that very high concentrations of analyte can actually inhibit complex formation, necessitating safeguards 30 that make the procedures more complex. Some of these Group 1 assays date right back to the discovery of antibodies and none of them have an actual "label" (e.g. Ag-enz). Other kinds of immunoassays that are label free depend on immunosensors, and a variety of instruments that can directly detect antibody-antigen interactions are now commercially available. Most depend on generating an evanescent wave on a sensor surface with immobilized ligand, which allows continuous monitoring of binding to the ligand. Immunosensors allow the easy investigation of kinetic interactions and, with the advent of lower-cost specialized instruments, may in the future find wide application in immunoanalysis.

c) Protein Separation

The use of immunoassays to detect a specific protein can involve the separation of the proteins by electophoresis. This can be done to separate FVIII from other proteins, as well as separating FVIII subtypes from each other. Electrophoresis is the migration of charged molecules in solution in response to an electric field. Their rate of migration depends on the strength of the field; on the net charge, size and shape of the molecules and also on the ionic strength, viscosity and temperature of the medium in which the molecules are moving. As an analytical tool, electrophoresis is simple, rapid and highly sensitive. It is used analytically to study the properties of a single charged species, and as a separation technique.

Generally the sample is run in a support matrix such as paper, cellulose acetate, starch gel, agarose or polyacrylamide gel. The matrix inhibits convective mixing caused by heating and provides a record of the electrophoretic run: at the end of the run, the matrix can be stained and used for scanning, autoradiography or storage. In addition, the most commonly used support matrices—agarose and polyacrylamide—provide a means of separating molecules by size, in that they are porous gels. A porous gel may act as a sieve by retarding, or in some cases completely obstructing, the movement of large macromolecules while allowing smaller molecules to migrate freely. Because dilute agarose gels are generally more rigid and easy to handle than polyacrylamide of the same concentration, agarose is used to separate larger macromolecules such as nucleic acids, large proteins and protein complexes. Polyacrylamide, which is easy to handle and to make at higher concentrations, is used to separate most proteins and small oligonucleotides that require a small gel pore size for retardation.

Proteins are amphoteric compounds; their net charge therefore is determined by the pH of the medium in which they are suspended. In a solution with a pH above its isoelectric point, a protein has a net negative charge and migrates towards the anode in an electrical field. Below its isoelectric point, the protein is positively charged and migrates towards the cathode. The net charge carried by a protein is in addition independent of its size—i.e., the charge carried per unit mass (or length, given proteins and nucleic acids are linear macromolecules) of molecule differs from protein to protein. At a given pH therefore, and under non-denaturing conditions, the electrophoretic separation of proteins is determined by both size and charge of the molecules.

Sodium dodecyl sulphate (SDS) is an anionic detergent which denatures proteins by "wrapping around" the polypeptide backbone—and SDS binds to proteins fairly specifically in a mass ratio of 1.4:1. In so doing, SDS confers a negative charge to the polypeptide in proportion to its length. Further, it is usually necessary to reduce disulphide bridges in proteins (denature) before they adopt the random-coil configuration necessary for separation by size: this is done with 2-mercaptoethanol or dithiothreitol (DTT). In denaturing SDS-PAGE separations therefore, migration is determined not by intrinsic electrical charge of the polypeptide, but by molecular weight.

Determination of Molecular Weight is done by SDS-PAGE of proteins of known molecular weight along with the protein to be characterized. A linear relationship exists between the logarithm of the molecular weight of an SDS-denatured polypeptide, or native nucleic acid, and its Rf. The Rf is calculated as the ratio of the distance migrated by the molecule to that migrated by a marker dye-front. A simple way of determining relative molecular weight by electrophoresis (Mr) is to plot a standard curve of distance migrated vs. log 10 MW for known samples, and read off the log Mr of the sample after measuring distance migrated on the same gel.

In two-dimensional electrophoresis, proteins are fractionated first on the basis of one physical property, and, in a second step, on the basis of another. For example, isoelectric focusing can be used for the first dimension, conveniently carried out in a tube gel, and SDS electrophoresis in a slab gel can be used for the second dimension. One example of a procedure is that of O'Farrell, P. H., *High Resolution Two-dimensional Electrophoresis of Proteins*, J. Biol. Chem. 250:4007-4021 (1975), herein incorporated by reference in its entirety for its teaching regarding two-dimensional electrophoresis methods. Other examples include but are not limited to, those found in Anderson, L and Anderson, N G, *High resolution two-dimensional electrophoresis of human plasma proteins*, Proc. Natl. Acad. Sci. 74:5421-5425 (1977), Ornstein, L., *Disc electrophoresis*, L. Ann. N.Y. Acad. Sci. 121:321349 (1964), each herein incorporated by reference in its entirety for its teaching regarding electrophoresis methods.

Laemmli, U. K., *Cleavage of structural proteins during the assembly of the head of bacteriophage T4*, Nature 227:680 (1970), herein incorporated by reference in its entirety for its teaching regarding electrophoresis methods, discloses a discontinuous system for resolving proteins denatured with SDS. The leading ion in the Laemmli buffer system is chloride, and the trailing ion is glycine. Accordingly, the resolving gel and the stacking gel are made up in Tris-HCl buffers (of different concentration and pH), while the tank buffer is Tris-glycine. All buffers contain 0.1% SDS.

Western Blot

One example of an immunoassay that uses electrophoresis that is contemplated in the current methods is Western Blot analysis. Western blot can be used to detect FV111 subtypes, for example, Western blotting or immunoblotting allows the determination of the molecular mass of a protein and the measurement of relative amounts of the protein present in different samples. Detection methods include chemiluminescence and chromagenic detection. Standard methods for Western Blot analysis can be found in, for example, D. M. Bollag et al., *Protein Methods* (2d edition 1996) and E. Harlow & D. Lane, *Antibodies, a Laboratory Manual* (1988), U.S. Pat. No. 4,452,901, each herein incorporated by reference in their entirety for their teaching regarding Western Blot methods. Generally, proteins are separated by gel electrophoresis, usually SDS-PAGE. The proteins are transferred to a sheet of special blotting paper, e.g., nitrocellulose, though other types of paper, or membranes, can be used. The proteins retain the same pattern of separation they had on the gel. The blot is incubated with a generic protein (such as milk proteins) to bind to any remaining sticky places on the nitrocellulose. An antibody is then added to the solution which is able to bind to its specific protein.

The attachment of specific antibodies to specific immobilized antigens can be readily visualized by indirect enzyme immunoassay techniques, usually using a chromogenic substrate (e.g. alkaline phosphatase or horseradish peroxidase) or chemiluminescent substrates. Other possibilities for probing include the use of fluorescent or radioisotope labels (e.g., fluorescein, $^{125}$I). Probes for the detection of antibody binding can be conjugated anti-immunoglobulins, conjugated staphylococcal Protein A (binds IgG), or probes to biotinylated primary antibodies (e.g., conjugated avidin/streptavidin).

The power of the technique lies in the simultaneous detection of a specific protein by means of its antigenicity, and its molecular mass: proteins are first separated by mass in the SDS-PAGE, then specifically detected in the immunoassay step. Thus, protein standards (ladders) can be run simultaneously in order to approximate molecular mass of the protein of interest in a heterogeneous sample.

d) Radioimmune Precipitation Assay (RIPA)

Radioimmune Precipitation Assay (RIPA) is a sensitive assay using radiolabeled antigens to detect specific antibodies in serum. The antigens are allowed to react with the serum and then precipitated using a special reagent such as, for example, protein A sepharose beads. The bound radiolabeled immunoprecipitate is then commonly analyzed by gel electrophoresis. Radioimmunoprecipitation assay (RIPA) is often used as a confirmatory test for diagnosing the presence of HIV antibodies. RIPA is also referred to in the art as Farr Assay, Precipitin Assay, Radioimmune Precipitin Assay; Radioimmunoprecipitation Analysis; Radioimmunoprecipitation Analysis, and Radioimmunoprecipitation Analysis.

e) Capture Assays

While the above immunoassays that utilize electrophoresis to separate and detect the specific proteins of interest allow for evaluation of protein size, they are not very sensitive for evaluating protein concentration. However, also contemplated are immunoassays wherein the protein or antibody specific for the protein is bound to a solid support (e.g., tube, well, bead, or cell) to capture the antibody or protein of interest, respectively, from a sample, combined with a method of detecting the protein or antibody specific for the protein on the support. Examples of such immunoassays include Radioimmunoassay (RIA), Enzyme-Linked Immunosorbent Assay (ELISA), Flow cytometry, protein array, multiplexed bead assay, and magnetic capture.

(1) Radioimmunoassay (RIA)

Radioimmunoassay (RIA) is a classic quantitative assay for detection of antigen-antibody reactions using a radioactively labeled substance (radioligand), either directly or indirectly, to measure the binding of the unlabeled substance to a specific antibody or other receptor system. Radioimmunoassay is used, for example, to test hormone levels in the blood without the need to use a bioassay. Non-immunogenic substances (e.g., haptens) can also be measured if coupled to larger carrier proteins (e.g., bovine gamma-globulin or human serum albumin) capable of inducing antibody formation.

RIA involves mixing a radioactive antigen (because of the ease with which iodine atoms can be introduced into tyrosine residues in a protein, the radioactive isotopes $^{125}$I or $^{131}$I are often used.) with antibody to that antigen. The antibody is generally linked to a solid support, such as the tube or beads. Unlabeled or "cold" antigen is then adding in known quantities and measuring the amount of labeled antigen displaced. Initially, the radioactive antigen is bound to the antibodies. When cold antigen is added, the two compete for antibody binding sites—and at higher concentrations of cold antigen, more binds to the antibody, displacing the radioactive variant. The bound antigens are separated from the unbound ones in solution and the radioactivity of each used to plot a binding curve. The technique is both extremely sensitive, and specific.

(2) ELISAs

Enzyme-Linked Immunosorbent Assay (ELISA), or more generically termed EIA (Enzyme ImmunoAssay), is an immunoassay that can detect an antibody specific for a protein. ELISA is useful with the methods disclosed herein, in that the FVIII protein can be detected using this assay, including but not limited to specific haplotypes of FVIII. In such an assay, a detectable label bound to either an antibody-binding or antigen-binding reagent is an enzyme. When exposed to its substrate, this enzyme reacts in such a manner as to produce a chemical moiety which can be detected, for example, by spectrophotometric, fluorometric or visual means. Enzymes which can be used to detectably label reagents useful for detection include, but are not limited to, horseradish peroxidase, alkaline phosphatase, glucose oxidase, β-galactosidase, ribonuclease, urease, catalase, malate dehydrogenase, staphylococcal nuclease, asparaginase, yeast alcohol dehydrogenase, alpha.-glycerophosphate dehydrogenase, triose phosphate isomerase, glucose-6-phosphate dehydrogenase, glucoamylase and acetylcholinesterase. For descriptions of ELISA procedures, see Voller, A. et al., J. Clin. Pathol. 31:507-520 (1978); Butler, J. E., Meth. Enzymol. 73:482-523 (1981); Maggio, E. (ed.), Enzyme Immunoassay, CRC Press, Boca Raton, 1980; Butler, J. E., In: Structure of Antigens, Vol. 1 (Van Regenmortel, M., CRC Press, Boca Raton, 1992, pp. 209-259; Butler, J. E., In: van Oss, C. J. et al., (eds), Immunochemistry, Marcel Dekker, Inc., New York, 1994, pp. 759-803; Butler, J. E. (ed.), Immunochemistry of Solid-Phase Immunoassay, CRC Press, Boca Raton, 1991); Crowther, "ELISA: Theory and Practice," In: Methods in Molecule Biology, Vol. 42, Humana Press; New Jersey, 1995.; U.S. Pat. No. 4,376,110, each incorporated herein by reference in its entirety and specifically for its teaching regarding ELISA methods.

Variations of ELISA techniques are know to those of skill in the art. In one variation, antibodies that can bind to proteins can be immobilized onto a selected surface exhibiting protein affinity, such as a well in a polystyrene microtiter plate. Then, a test composition suspected of containing a marker antigen can be added to the wells. After binding and washing to remove non-specifically bound immunocomplexes, the bound antigen can be detected. Detection can be achieved by the addition of a second antibody specific for the target protein, which is linked to a detectable label. This type of ELISA is a simple "sandwich ELISA". Detection also can be achieved by the addition of a second antibody, followed by the addition of a third antibody that has binding affinity for the second antibody, with the third antibody being linked to a detectable label.

Another variation is a competition ELISA. In competition ELISA's, test samples compete for binding with known amounts of labeled antigens or antibodies. The amount of reactive species in the sample can be determined by mixing the sample with the known labeled species before or during incubation with coated wells. The presence of reactive species in the sample acts to reduce the amount of labeled species available for binding to the well and thus reduces the ultimate signal.

Irrespective of the format employed, ELISAs have certain features in common, such as coating, incubating or binding, washing to remove non-specifically bound species, and detecting the bound immunecomplexes. Antigen or antibodies can be linked to a solid support, such as in the form of plate, beads, dipstick, membrane or column matrix, and the sample to be analyzed applied to the immobilized antigen or antibody. In coating a plate with either antigen or antibody, one will generally incubate the wells of the plate with a solution of the antigen or antibody, either overnight or for a specified period of hours. The wells of the plate can then be washed to remove incompletely adsorbed material. Any remaining available surfaces of the wells can then be "coated" with a nonspecific protein that is antigenically neutral with regard to the test antisera. These include bovine serum albumin (BSA), casein and solutions of milk powder. The coating allows for blocking of nonspecific adsorption sites on the immobilizing surface and thus reduces the background caused by nonspecific binding of antisera onto the surface.

In ELISAs, a secondary or tertiary detection means rather than a direct procedure can also be used. Thus, after binding of a protein or antibody to the well, coating with a non-reactive material to reduce background, and washing to remove unbound material, the immobilizing surface is contacted with the control clinical or biological sample to be tested under conditions effective to allow immunecomplex (antigen/antibody) formation. Detection of the immunecomplex then requires a labeled secondary binding agent, or a secondary binding agent in conjunction with a labeled third binding agent.

"Under conditions effective to allow immunecomplex (antigen/antibody) formation" means that the conditions include diluting the antigens and antibodies with solutions such as BSA, bovine gamma globulin (BGG) and phosphate buffered saline (PBS)/Tween. These added agents can also assist in the reduction of nonspecific background.

The "suitable" conditions also mean that the incubation is at a temperature and for a period of time sufficient to allow effective binding. Incubation steps can typically be from about 1 minute to twelve hours, at temperatures of about 20° to 30° C., or can be incubated overnight at about 0° C. to about 10° C.

Following all incubation steps in an ELISA, the contacted surface can be washed so as to remove non-complexed material. A washing procedure can include washing with a solution such as PBS/Tween, or borate buffer. Following the formation of specific immunecomplexes between the test sample and the originally bound material, and subsequent washing, the occurrence of even minute amounts of immunecomplexes can be determined.

To provide a detecting means, the second or third antibody can have an associated label to allow detection, as described above. This can be an enzyme that can generate color development upon incubating with an appropriate chromogenic substrate. Thus, for example, one can contact and incubate the first or second immunecomplex with a labeled antibody for a period of time and under conditions that favor the development of further immunecomplex formation (e.g., incubation for 2 hours at room temperature in a PBS-containing solution such as PBS-Tween).

After incubation with the labeled antibody, and subsequent to washing to remove unbound material, the amount of label can be quantified, e.g., by incubation with a chromogenic substrate such as urea and bromocresol purple or 2,2'-azido-di-(3-ethyl-benzthiazoline-6-sulfonic acid [ABTS] and $H_2O_2$, in the case of peroxidase as the enzyme label. Quantitation can then be achieved by measuring the degree of color generation, e.g., using a visible spectra spectrophotometer.

(3) Flow Cytometry

Flow cytometry can be used to detect various FVIII haplotypes, and can be used to purify mixed samples of haplotypes, as disclosed herein. Flow cytometry, fluorescent activated cell sorting (FACS), or flow microfluorometry provides the means of scanning individual cells for the presence of a molecule of interest. Flow Cytometry is the characterization of single cells as they pass at high speed through a laser beam. While a hematologist can count 200 cells in less than a minute by hand (hemocytometer) on a stage microscope, a flow cytometer can discriminate cells at speeds up to 50,000 cells/second. The Flow component is a fluidics system that precisely delivers the cells at the intersection of the laser beam and light gathering lens by hydrodynamic focusing (a single stream of cells is injected and confined within an outer stream at greater pressure). The laser acting as a light source develops parameters of light scatter as well as exciting the fluorescent molecules used to label the cell. Cells are characterized individually by their physical and/or chemical properties (Kohler, G. and Milstein, C. (1975) Continuous Cultures of Fused Cells Secreting Antibody of Predefined Specificity. Nature 256: p. 495-49) which provide analytical parameters capable of accurate quantitation of the number of molecules/cell through Quantitative Flow Cytometry (QFCM). The physical (morphological) profile of a cell can be observed by combining forward light scatter (FS) and orthogonal or side light scatter (SSC). In forward light scatter the laser beam is interrupted by the cell and the light that passes around the cell is measured. Comparable to casting shadow puppets on a wall with a flashlight. This measurement is an indication of the cell's unique refractive index which depends on a cell's size, organelles, water and molecular contents. The refractive index (forward scatter) of a cell can change through cell cycle progression, activation, fixation, etc. Cellular side scatter is the light that is reflected 90° to the laser beam (all fluorescence is emitted and therefore collected at this angle) and is an indication of cytoplasmic density or cell surface granularity.

A short list of some of the information that can be discerned by multiparameter (multi-color) Flow Cytometry includes; Apoptosis (programmed cell death), Cell Type, DNA Content, Enzyme Activity, Intracellular Proteins, Cell Surface Antigens, Cytoplasmic Granularity, Surface Membrane Integrity, Intracellular [Ca++]-Signal Transduction, DNA Synthesis-Proliferation, Cell Surface Receptors, Intracellular Cytokines, Oxidative Metabolism, Intracellular pH, RNA Content, and Cell Size.

Antibodies can provide a useful tool for the analysis and quantitation of markers of individual cells. Such flow cytometric analyses are described in Melamed, et al., *Flow Cytometry and Sorting* (1990); Shapiro, *Practical Flow Cytometry* (1988); and Robinson, et al., *Handbook of Flow Cytometry Methods* (1993), each herein incorporated by reference in its entirety for their teaching regarding FACS. Generally, proteins are detected with antibodies that have been conjugated to fluorescent molecules such as FITC, PE, Texas Red, APC, etc. Detection of molecules on the cell surface (immunophenotyping) is most common, but with a few modifications, proteins can be identified in the cytoplasm (e.g. cytokines), or in the nucleus (e.g. cell cycle control proteins).

By tagging antibodies with a colored fluorochrome, it is easy to distinguish the cell type and quantity of antigens expressed by each cell. Employing dichroic splitting mirrors, band pass filters and compensation, the colors can be resolved where each color is associated with a single antibody. As each cell, tagged with a fluorescently labeled antibody, enters the laser light outer orbital electrons in the fluorochrome are excited at a specific excitation wavelength (e.g., 494 nm for FITC). As it transitions the width of the laser beam maximum peak fluorescence is achieved within approximately 10 nsec as the excited outer orbital electrons return to their more stable ground state and emit a photon of light at a longer wavelength (e.g., 520 nm for FITC) than that at which they were excited. Photomultiplier tubes (PMT's) detect these faint fluorescent signals and their sole role is to change discrete packets of light called photons (hv) into electrons and amplify them by producing as much as 10 million electrons for every photon captured.

In addition, cytoplasmic and nuclear membranes can be breached (permeabilized) to introduce, for example, antibodies against intracellular proteins or stain nucleic acids with intercalating dyes (propidium iodide, 7-AAD, etc.) or DNA base specific dyes (Hoescht). In addition, BrdU incorporation for cell proliferation can be measured by immunofluorescence. DNA intercalating dyes, such as for example propidium iodide, allow the identification of which cells are diploid (GO, resting, non-dividing cells, or any cycling cells in G1), which cells are in S phase of the cell cycle during which DNA is replicated, and which cells are G2 or in mitosis. Tumor cells are often aneuploid—that is, they have too many or too few chromosomes compared to the normal diploid DNA number for the species.

Apoptosis can be measured in a number of ways. The TUNEL technique identifies DNA strand breaks. Annexin V immunolabeling detects changes in the plasma membrane asymmetry. Nuclear condensation and DNA loss are demonstrated by hypodiploid peaks in DNA content experiments. Uptake of Hoechst 33258 has also been shown to increase with apoptotic changes.

Fluorescence-activated cell sorting (FACS) is a type of flow cytometry. FACS is a method for sorting a suspension of biologic cells into two or more containers, one cell at a time. Fluorescence-activated cell sorting is based upon specific light scattering and fluorescence characteristics of each cell. In FACS, the cell suspension is entrained in the center of a narrow, rapidly flowing stream of liquid. The flow is arranged so that there is a large separation between cells relative to their diameter. A vibrating mechanism causes the stream of cells to break into individual droplets. The system is adjusted so that there is a low probability of more than one cell being in a droplet. Just before the stream breaks into droplets the flow passes through a fluorescence measuring station where the fluorescence character of interest of each cell is measured. An electrical charging ring is placed just at the point where the stream breaks into droplets. A charge is placed on the ring based on the immediately prior fluorescence intensity measurement and the opposite charge is trapped on the droplet as it breaks from the stream. The charged droplets then fall through an electrostatic deflection system that diverts droplets into containers based upon their charge.

(4) Protein Arrays

Protein arrays are useful with the methods disclosed herein as assays for detection of various FVIII haplotypes in an individual or in collective samples, for example. Protein arrays are solid-phase ligand binding assay systems using immobilised proteins on surfaces which include glass, membranes, microtiter wells, mass spectrometer plates, and beads or other particles. The assays are highly parallel (multiplexed) and often miniaturised (microarrays, protein chips). Their advantages include being rapid and automatable, capable of high sensitivity, economical on reagents, and giving an abundance of data for a single experiment. Bioinformatics support is important; the data handling demands sophisticated software and data comparison analysis. However, the software can be adapted from that used for DNA arrays, as can much of the hardware and detection systems.

One of the chief formats is the capture array, in which ligand-binding reagents, which are usually antibodies but can also be alternative protein scaffolds, peptides or nucleic acid aptamers, are used to detect target molecules in mixtures such as plasma or tissue extracts. In diagnostics, capture arrays can be used to carry out multiple immunoassays in parallel, both testing for several analytes in individual sera for example and testing many serum samples simultaneously. In proteomics, capture arrays are used to quantitate and compare the levels of proteins in different samples in health and disease, i.e. protein expression profiling. Proteins other than specific ligand binders are used in the array format for in vitro functional interaction screens such as protein-protein, protein-DNA, protein-drug, receptor-ligand, enzyme-substrate, etc. They may also be used to correlate the polymorphic changes resulting from SNPs with protein function. The capture reagents themselves are selected and screened against many proteins, which can also be done in a multiplex array format against multiple protein targets.

For construction of arrays, sources of proteins include cell-based expression systems for recombinant proteins, purification from natural sources, production in vitro by cell-free translation systems, and synthetic methods for peptides. Many of these methods can be automated for high throughput production. For capture arrays and protein function analysis, it is important that proteins should be correctly folded and functional; this is not always the case, e.g. where recombinant proteins are extracted from bacteria under denaturing conditions. Nevertheless, arrays of denatured proteins are useful in screening antibodies for cross-reactivity, identifying autoantibodies and selecting ligand binding proteins.

Protein arrays have been designed as a miniaturisation of familiar immunoassay methods such as ELISA and dot blotting, often utilizing fluorescent readout, and facilitated by robotics and high throughput detection systems to enable multiple assays to be carried out in parallel. Commonly used physical supports include glass slides, silicon, microwells, nitrocellulose or PVDF membranes, and magnetic and other microbeads. While microdrops of protein delivered onto planar surfaces are the most familiar format, alternative architectures include CD centrifugation devices based on developments in microfluidics [Gyros] and specialised chip designs, such as engineered microchannels in a plate [The Living Chip™ Biotrove] and tiny 3D posts on a silicon surface [Zyomyx]. Particles in suspension can also be used as the basis of arrays, providing they are coded for identification; systems include colour coding for microbeads [Luminex, Bio-Rad] and semiconductor nanocrystals [QDots™, Quantum Dots], and barcoding for beads [UltraPlex™, Smartbeads] and multimetal microrods [Nanobarcodes™ particles, Nanoplex Technologies]. Beads can also be assembled into planar arrays on semiconductor chips [LEAPS technology, BioArray Solutions].

Immobilization of proteins involves both the coupling reagent and the nature of the surface being coupled to. A good protein array support surface is chemically stable before and after the coupling procedures, allows good spot morphology, displays minimal nonspecific binding, does not contribute a background in detection systems, and is compatible with different detection systems. The immobilization method used are reproducible, applicable to proteins of different properties (size, hydrophilic, hydrophobic), amenable to high throughput and automation, and compatible with retention of fully functional protein activity. Orientation of the surface-bound protein is recognized as an important factor in presenting it to ligand or substrate in an active state; for capture arrays the most efficient binding results are obtained with orientated capture reagents, which generally require site-specific labeling of the protein.

Both covalent and noncovalent methods of protein immobilization are used and have various pros and cons. Passive adsorption to surfaces is methodologically simple, but allows little quantitative or orientational control; it may or may not alter the functional properties of the protein, and reproducibility and efficiency are variable. Covalent coupling methods provide a stable linkage, can be applied to a range of proteins and have good reproducibility; however, orientation may be variable, chemical derivatization may alter the function of the protein and requires a stable interactive surface. Biological capture methods utilizing a tag on the protein provide a stable linkage and bind the protein specifically and in reproducible orientation, but the biological reagent must first be immobilized adequately and the array may require special handling and have variable stability.

Several immobilization chemistries and tags have been described for fabrication of protein arrays. Substrates for covalent attachment include glass slides coated with amino- or aldehyde-containing silane reagents. In the Versalinx™ system [Prolinx], reversible covalent coupling is achieved by interaction between the protein derivatised with phenyldiboronic acid, and salicylhydroxamic acid immobilized on the support surface. This also has low background binding and low intrinsic fluorescence and allows the immobilized proteins to retain function. Noncovalent binding of unmodified protein occurs within porous structures such as HydroGel™ [PerkinElmer], based on a 3-dimensional polyacrylamide gel; this substrate is reported to give a particularly low background on glass microarrays, with a high capacity and retention of protein function. Widely used biological coupling methods are through biotin/streptavidin or hexahistidine/Ni interactions, having modified the protein appropriately. Biotin may be conjugated to a poly-lysine backbone immobilised on a surface such as titanium dioxide [Zyomyx] or tantalum pentoxide [Zeptosens].

Array fabrication methods include robotic contact printing, ink-jetting, piezoelectric spotting and photolithography. A number of commercial arrayers are available [e.g. Packard Biosience] as well as manual equipment [V & P Scientific]. Bacterial colonies can be robotically gridded onto P'VDF membranes for induction of protein expression in situ.

At the limit of spot size and density are nanoarrays, with spots on the nanometer spatial scale, enabling thousands of reactions to be performed on a single chip less than 1 mm square. BioForce Laboratories have developed nanoarrays with 1521 protein spots in 85 sq microns, equivalent to 25 million spots per sq cm, at the limit for optical detection; their readout methods are fluorescence and atomic force microscopy (AFM).

Fluorescence labeling and detection methods are widely used. The same instrumentation as used for reading DNA microarrays is applicable to protein arrays. For differential display, capture (e.g. antibody) arrays can be probed with fluorescently labeled proteins from two different cell states, in which cell lysates are directly conjugated with different fluorophores (e.g. Cy-3, Cy-5) and mixed, such that the color acts as a readout for changes in target abundance. Fluorescent readout sensitivity can be amplified 10-100 fold by tyramide signal amplification (TSA) [PerkinElmer Lifesciences]. Planar waveguide technology [Zeptosens] enables ultrasensitive fluorescence detection, with the additional advantage of no intervening washing procedures. High sensitivity can also be achieved with suspension beads and particles, using phycoerythrin as label [Luminex] or the properties of semiconductor nanocrystals [Quantum Dot]. A number of novel alternative readouts have been developed, especially in the commercial biotech arena. These include adaptations of surface plasmon resonance [HTS Biosystems, Intrinsic Bioprobes], rolling circle DNA amplification [Molecular Staging], mass spectrometry [Ciphergen, Intrinsic Bioprobes], resonance light scattering [Genicon Sciences] and atomic force microscopy [BioForce Laboratories].

Capture arrays form the basis of diagnostic chips and arrays for expression profiling. They employ high affinity capture reagents, such as conventional antibodies, single domains, engineered scaffolds, peptides or nucleic acid aptamers, to bind and detect specific target ligands in high throughput manner Antibody arrays have the required properties of specificity and acceptable background, and some are available commercially [BD Biosciences Clontech, BioRad, Sigma]. Antibodies for capture arrays are made either by conventional immunization (polyclonal sera and hybridomas), or as recombinant fragments, usually expressed in E. coli, after selection from phage or ribosome display libraries [Cambridge Antibody Technology, BioInvent, Affitech, Biosite]. In addition to the conventional antibodies, Fab and scFv fragments, single V-domains from camelids or engineered human equivalents [Domantis] may also be useful in arrays.

The term 'scaffold' refers to ligand-binding domains of proteins, which are engineered into multiple variants capable of binding diverse target molecules with antibody-like properties of specificity and affinity. The variants can be produced in a genetic library format and selected against individual targets by phage, bacterial or ribosome display. Such ligand-binding scaffolds or frameworks include 'Affibodies' based on Staph. aureus protein A [Affibody], 'Trinectins' based on fibronectins [Phylos] and 'Anticalins' based on the lipocalin structure [Pieris]. These can be used on capture arrays in a similar fashion to antibodies and may have advantages of robustness and ease of production.

Nonprotein capture molecules, notably the single-stranded nucleic acid aptamers which bind protein ligands with high specificity and affinity, are also used in arrays [SomaLogic]. Aptamers are selected from libraries of oligonucleotides by the Selex™ procedure and their interaction with protein can be enhanced by covalent attachment, through incorporation of brominated deoxyuridine and UV-activated crosslinking (photoaptamers). Photocrosslinking to ligand reduces the crossreactivity of aptamers due to the specific steric requirements. Aptamers have the advantages of ease of production by automated oligonucleotide synthesis and the stability and robustness of DNA; on photoaptamer arrays, universal fluorescent protein stains can be used to detect binding.

Protein analytes binding to antibody arrays may be detected directly or via a secondary antibody in a sandwich assay. Direct labelling is used for comparison of different samples with different colours. Where pairs of antibodies directed at the same protein ligand are available, sandwich immunoassays provide high specificity and sensitivity and are therefore the method of choice for low abundance proteins such as cytokines; they also give the possibility of detection of protein modifications. Label-free detection methods, including mass spectrometry, surface plasmon resonance and atomic force microscopy, avoid alteration of ligand. What is required from any method is optimal sensitivity and specificity, with low background to give high signal to noise. Since analyte concentrations cover a wide range, sensitivity has to be tailored appropriately; serial dilution of the sample or use of antibodies of different affinities are solutions to this problem. Proteins of interest are frequently those in low concentration in body fluids and extracts, requiring detection in the pg range or lower, such as cytokines or the low expression products in cells.

The question of cross-reactivity is an important one which applies to all ligand binders and particularly to antibodies, being the most popular reagents. While antibodies are thought of as being highly specific, monoclonals can show unpredictable cross-reactions which will be revealed by thorough screening. The ultimate usefulness of individual reagents then depends on the relative level of cross-reaction and specific reaction. The use of sandwich assays, in which antibody pairs are used to bind and detect ligand, may go a long way towards eliminating the problem, since it is unlikely that both members of the sandwich will exhibit the same cross-reactivity. Polyclonal antibodies are emerging as array reagents for protein expression studies; although they require affinity purification, rabbit sera are easier to produce than monoclonals, and cross-reactions may be reduced as a result of heterogeneity. There are ambitious projects to raise monoclonal antibodies and antisera against the entire human proteome.

An important general principle is that, for optimal specificity where assays are highly multiplexed, it is essential to provide dual level target recognition, i.e. two levels of specificity for each locus in the array. Sandwich assays achieve this with two antibodies, photocrosslinking reduces the cross-reactivity of aptamers and MS provides definitive label-free protein identification.

An alternative to an array of capture molecules is one made through 'molecular imprinting' technology, in which peptides (e.g. from the C-terminal regions of proteins) are used as templates to generate structurally complementary, sequence-specific cavities in a polymerisable matrix; the cavities can then specifically capture (denatured) proteins which have the appropriate primary amino acid sequence [ProteinPrint™, Aspira Biosystems].

Another methodology which can be used diagnostically and in expression profiling is the ProteinChip® array [Ciphergen], in which solid phase chromatographic surfaces bind proteins with similar characteristics of charge or hydrophobicity from mixtures such as plasma or tumour extracts, and SELDI-TOF mass spectrometry is used to detection the retained proteins. The ProteinChip® is credited with the ability to identify novel disease markers. However, this technology differs from the protein arrays under discussion here since, in general, it does not involve immobilisation of individual proteins for detection of specific ligand interactions.

Large-scale functional chips have been constructed by immobilising large numbers of purified proteins and used to assay a wide range of biochemical functions, such as protein interactions with other proteins, drug-target interactions, enzyme-substrates, etc. Generally they require an expression library, cloned into E. coli, yeast or similar from which the expressed proteins are then purified, e.g. via a His tag, and immobilised. Cell free protein transcription/translation is a viable alternative for synthesis of proteins which do not express well in bacterial or other in vivo systems.

For detecting protein-protein interactions, protein arrays can be in vitro alternatives to the cell-based yeast two-hybrid system and may be useful where the latter is deficient, such as interactions involving secreted proteins or proteins with disulphide bridges. High-throughput analysis of biochemical activities on arrays has been described for yeast protein kinases and for various functions (protein-protein and protein-lipid interactions) of the yeast proteome, where a large proportion of all yeast open-reading frames was expressed and immobilised on a microarray. Large-scale 'proteome chips' promise to be very useful in identification of functional interactions, drug screening, etc. [Proteometrix]. Another possible screen will be for the effect of polymorphisms arising from disease-related coding SNPs (SAPs, single amino acid polymorphisms); such information may be valuable in ascertaining the effects of SNPs on drug responses and side effects in patients (pharmacogenomics).

One restriction is that proteins which are only functional as multicomponent complexes will probably not be analysable on protein arrays.

As a two-dimensional display of individual elements, a protein array can be used to screen phage or ribosome display libraries, in order to select specific binding partners, including antibodies, synthetic scaffolds, peptides and aptamers. In this way, 'library against library' screening can be carried out. Screening of drug candidates in combinatorial chemical libraries against an array of protein targets identified from genome projects is another application of the approach.

(5) Multiplexed Bead Assay

A multiplexed bead assay, such as for example the BD™ Cytometric Bead Array, is a series of spectrally discrete particles that can be used to capture and quantitate soluble analytes. The analyte is then measured by detection of a fluorescence-based emission and flow cytometric analysis. Multiplexed bead assay generates data that is comparable to ELISA based assays, but in a "multiplexed" or simultaneous fashion. Concentration of unknowns is calculated for the cytometric bead array as with any sandwich format assay, i.e. through the use of known standards and plotting unknowns against a standard curve. Further, multiplexed bead assay allows quantification of soluble analytes in samples never previously considered due to sample volume limitations. In addition to the quantitative data, powerful visual images can be generated revealing unique profiles or signatures that provide the user with additional information at a glance.

(6) Magnetic Capture

Antibody-coated magnetic particles can be used to capture and selectively separate target cells or specific chemicals from solution. In the technique, target-specific antibody is bound to a magnetic particle (often termed an immunobead). After reaction time to allow binding of immunobead and target, a strong magnetic field is applied to selectively separate the captured target-particle complexes from the milieu.

(7) Imunocytochemistry/Immunohistochemistry

Also provided are methods of detecting a substance of interest such as a protein, such as FVIII subtypes, in vivo or in situ using antibody conjugates. Imunocytochemistry and immunohistochemistry are techniques for identifying cellular or tissue constituents, respectively, by means of antigen-antibody interactions. The methods generally involve administering to an animal or subject an imaging-effective amount of a detectably-labeled protein-specific antibody or fragment thereof, and then detecting the location of the labeled antibody in the sample cell or tissue. An "imaging effective amount" is an amount of a detectably-labeled antibody, or fragment thereof, that when administered is sufficient to enable later detection of binding of the antibody or fragment in the specific cell or tissue. The effective amount of the antibody-marker conjugate is allowed sufficient time to come into contact with reactive antigens that are present within the tissues of the subject, and the subject is then exposed to a detection device to identify the detectable marker.

Administration of the antibodies can be done as disclosed herein. Nucleic acid approaches for antibody delivery also exist. The antibodies and antibody fragments disclosed herein can also be administered to patients or subjects as a nucleic acid preparation (e.g., DNA or RNA) that encodes the antibody or antibody fragment, such that the patient's or subject's own cells take up the nucleic acid and produce and secrete the encoded antibody or antibody fragment. The delivery of the nucleic acid can be by any means, as disclosed herein, for example Administration of the antibody can be local or systemic and accomplished intravenously, intra-arterially, via the spinal fluid or the like. Administration also can be intradermal or intracavitary, depending upon the body site under examination. After a sufficient time has lapsed for the labeled antibody or fragment to bind to the diseased tissue, for example 30 minutes to 48 hours, the area of the subject under investigation can then be examined by an imaging technique, such as those described herein.

The distribution of the bound radioactive isotope and its increase or decrease with time can be monitored and recorded. By comparing the results with data obtained from studies of clinically normal individuals, the presence and extent of the diseased tissue can be determined.

The exact imaging protocol will necessarily vary depending upon factors specific to the subject, and depending upon the body site under examination, method of administration, type of label used and the like. One of ordinary skill in the art will be able to determine which imaging protocol to use based on these factors. Effective dosages and schedules for administering the compositions can be determined empirically, and making such determinations is within the skill in the art. The dosage ranges for the administration of the compositions are those large enough to produce the desired effect in which the symptoms of the disorder are affected. The dosage should not be so large as to cause adverse side effects, such as unwanted cross-reactions, anaphylactic reactions, and the like. Generally, the dosage will vary with the age, condition, sex and extent of the disease in the patient, route of administration, or whether other drugs are included in the regimen, and can be determined by one of skill in the art. The dosage can be adjusted by the individual physician in the event of any counterindications. Dosage can vary, and can be administered in one or more dose administrations daily, for one or several days. Guidance can be found in the literature for appropriate dosages for given classes of pharmaceutical products. For example, guidance in selecting appropriate doses for antibodies can be found in the literature on therapeutic uses of antibodies, e.g., Ferrone et al., *Handbook of Monoclonal Antibodies*, (1985) ch. 22 and pp. 303-357; Haber et al., *Antibodies in Human Diagnosis and Therapy*, (1977) pp. 365-389. A typical daily dosage of the antibody used alone might range from about 1 µg/kg to up to 100 mg/kg of body weight or more per day, depending on the factors mentioned above.

3. Methods of Factor Inhibitor Detection (Bethesda Assay)

Inhibitor to Factor VIII is screened for by mixing test plasma with a known amount of Factor VIII. After a 2 hour incubation period at 37° C., the residual Factor VIII activity is determined in a factor VIII assay. By comparing the difference in the Factor VIII activity of the patient incubation mixture and a control mixture, the absence or presence of a Factor VIII inhibitor can be demonstrated. Some antibodies will only prolong the Protein Truncation Test (PTT) after incubation. The assay disclosed herein can utilize blood plasma that contains only one of the 6 wildtype form of FVIII protein.

Factor VIII inhibitors, IgG antibodies directed against factor VIII, can occur in alloimmunized patients with congenital factor VIII deficiency (Hemophilia A) or as autoantibodies. The latter are associated with pregnancy, autoimmune disease, or drugs but most often occur spontaneously, particularly among elderly persons.

General steps involved in a Bethesda assay for factor VICE inhibitor include: Serial subject plasma dilutions in citrated saline are prepared, from 1:1 up to 1:160 (or higher if necessary for high-titer factor inhibitors). The purpose of these dilutions is to dilute out the inhibitor. The patient plasma dilutions are then mixed with an equal volume of normal plasma containing a normal amount of coagulation factors. The mixed dilutions are usually incubated for up to 2 hours, because certain inhibitors show an inhibitory effect only after prolonged incubation (particularly factor V and factor VIII inhibitors). Factor VIII assays are then performed on each mixed dilution. The dilution that inhibits 50% of factor VIII in the assay defines the titer of the inhibitor. For example, if the 1:40 dilution inhibits 50% of the factor VIII in the assay, the patient is reported to have a titer of 40 BU of factor VIII inhibitor.

Porcine factor VIII can be substituted for normal plasma (which contains human factor VIII) in the Bethesda assay to determine if the factor VIII inhibitor cross-reacts with porcine factor VIII. If there is little or no cross-reactivity, porcine factor VIII is often used to treat bleeding due to a factor VIII inhibitor.

The Bethesda assay can be modified to identify and titer other specific factor inhibitors. For example, if a factor V inhibitor is suspected, factor V assays are performed on the mixed dilutions instead of factor VIII assays.

Antibodies that inhibit the activity of a specific coagulation factor can develop spontaneously or in association with certain medications, autoimmune diseases, or other conditions. These antibodies may also arise when a patient with a hereditary factor deficiency is transfused with a product containing the factor, such as a factor concentrate or fresh frozen plasma. The immune system in the patient with the deficiency views the transfused factor as foreign, and forms an antibody against the transfused factor. This complication makes treatment of bleeding episodes difficult in such patients. The most common clinically significant factor inhibitor is a factor VIII inhibitor. Factor VIII inhibitors cause decreased factor VIII activity and consequently a prolonged PTT. Factor VIII inhibitors exhibit a characteristic pattern in the PTT mixing study where the mixed plasma PTT is initially normal (or significantly more normal than the patient plasma's PTT) but becomes prolonged (typically by increasing at least 8-10 seconds) over the course of a 1- to 2-hour incubation.

Use of the Haplotype-Specific Bethesda Assay in Patients with Acquired Hemophilia a When a non-hemophilic patient presents with bleeding, whether or not it is reminiscent of hemorrhagic episodes seen in hemophilia patients, they undergo a diagnostic evaluation for identifying the common acquired bleeding disorders via testing performed in the Clinical Hemostasis Laboratory Inhibitors are usually first detected using a sensitive clotting-based assay, variably referred to as an inhibitor screen or a mixing study. If a coagulation factor inhibitor is suspected from the results of the screening assay, the specificity of these antibodies (i.e., anti-FVIII- vs anti-FIX- vs anti-FV- vs anti-vWF-antibodies) is usually determined by performing clotting-based assays that are specific for the different coagulation factors. Once the presence and specificity of the suspected inhibitor has been determined, their presence and specificity are most often confirmed by performing the more specific clotting-based test known as the Bethesda assay. The plasma level (i.e. titer) of an inhibitor, likewise, is typically measured by the Bethesda assay and is defined in terms of Bethesda units (BU).

While use of the traditional Bethesda assay, as described above, can confirm the specificity of an inhibitor as recognizing FVIII, and not another coagulation factor, because it is based on pooled normal plasma as the "wildtype FVIII source", one cannot determine the specificity of the inhibitor towards the six structurally-distinct forms of the wildtype FVIII protein expressed by humans. Using the Haplotype-Specific Bethesda assay disclosed herein, the reactivity of the auto-FVIII antibodies can be specifically evaluated in a patient with acquired hemophilia A, towards the different forms of the human FVIII protein. These autoantibodies, by definition, should be directed against the patient's own (i.e. "self") FVIII molecule(s). Acquired hemophilia A, in contrast to the congenital form, affects both males and females, although it has been observed more frequently in women then men. Since females have two X-chromosomes and therefore two F8, the wildtype FVIII protein they express may all represent the same wildtype form (i.e. haplotype) or two distinct haplotypes of the protein. Therefore, the autoanti-FVIII antibodies in female patients with acquired hemophilia A may represent either one, or at most two, of the six naturally-occurring forms of the human FVIII. After determining the FVIII haplotype(s) in a patient with acquired hemophilia A, the disclosed Haplotype-Specific Bethesda assay can be used to determine the haplotype(s) against which their antoanti-FVIII antibodies are reactive. If a given patient's inhibitors are directed against only their own endogenous FVIII molecule(s), or react with one or more of the other forms of the wildtype FVIII protein less then with their own, this Bethesda assay can be used to provide them with the most appropriate replacement FVIII product (i.e., the FVIII haplotype least reactive with their serum).

a) Detection and Quantification of Inhibitors

Factor replacement therapy, the intravenous infusion of concentrated, purified preparations of either recombinant (r) or plasma-derived (p) wildtype human FVIII, is the most widely used and effective means of arresting and/or preventing bleeding in patients with hemophilia A. Unfortunately, the exogenous FVIII protein is seen as a foreign in ~25% of patients and becomes targeted by functionally neutralizing alloantibodies, termed inhibitors. Because inhibitors can leave patients refractory to further treatment with FVIII, and necessitate the use of alternative therapies that are less desirable from a clinical and economic standpoint, the development of such antibodies is considered to be the most serious complication in the management of hemophilia A. Therefore, all patients with hemophilia A should be periodically tested for the presence of inhibitors.

Different methods have been used to detect and quantify inhibitors, as well as non-inhibitory anti-FVIII antibodies. Typically, however, a traditional Bethesda assay, with or without the Njiemegan modification, has been performed on all hemophilia A patients testing positive in an a PTT-based plasma mixing study, which are often referred to as an inhibitor screen. Dilutions of a patient's plasma is then mixed with a pooled normal plasma (PNP), which is derived from a large collection of healthy unrelated blood donors and therefore contains wildtype FVIII, and incubated at 37° C. for two hours. At the end of the two hours, a FVIII activity (FVIII:C) assay is performed on the mixtures, using a reagent plasma deficient for FVIII:C, so that the amount of residual FVIII:C can be calculated. This method has also been used to detect other factor inhibitors through the use of PNP that has been immunodepleted of the coagulation protein suspected of being the target.

The Bethesda assay has long been known to have several shortcomings, which include, among others, a poor sensitivity to low-titre antibodies and a poor specificity near the cut-off. While this has been attributed, at least in part, to the complex reaction kinetics of some inhibitors, this needs to be re-investigated in light of the recent discovery that humans express at least six structurally-distinct forms of the wildtype FVIII protein. Since the Bethesda assay uses PNP as the source of FVIII to detect inhibitors in patient plasmas, it is clear that this finding, which demonstrates as inaccurate the long-held view that FVIII is monomorphic at the protein level in the non-hemophilic human population, could account for at least some of the problems associated with the Bethesda assay.

Assay principle: An inhibitor to FVIII, or more accurately FVIII:C, is quantitated by mixing the patient's plasma, which is known as the test plasma, with a FVIII source plasma, that has typically been a PNP containing a known amount of "wildtype" FVIII:C. After an incubation period, the residual FVIII:C activity level is measured in an aPTT-based specific FVIII activity assay that also requires FVIII deficient plasma. By comparing the difference in FVIII:C levels of the patient incubation mixtures and a control mixture, the amount of inhibitor present can be calculated in Bethesda units (BU's). One BU of inhibitor is defined as the amount of inhibitor that will inactivate 50% of the original FVIII:C level present.

The novel Haplotype-Specific Bethesda assay incorporates the recent discovery that, due to the presence of four non-synonymous SNPs (nsSNPs) in the FVIII gene (F8), humans express six wildtype forms of the coagulation FVIII protein, referred to as haplotypes H1, H2, H3, H4, H5, and H6. Through the use of immunodepleted FVIII-deficient human plasmas that have been reconstituted with purified recombinant (r) FVIII preparations that represent one of the six forms of the human protein, different homogeneous FVIII source plasmas are available that can be used to maximize the sensitive of this ssay in a given patient by testing their plasma for antibodies against only the form of the molecule(s) that they have been treated with. This novel strategy simultaneously increases the specificity of the traditional Bethesda assay, by also testing a patient's plasma against a source plasma containing only the wildtype FVIII protein corresponding to their own background form of the molecule.

b) Specimen Requirements

A. Collect patient's blood in two B-D blue-top siliconized Vacutainer tubes containing 0.5 mL of 0.1M buffered sodium citrate (3.2% sodium citrate).
B. If drawing with a syringe, use a 2-syringe technique, discarding blood in the first syringe or using it for other tests. Blood for test should come from the second syringe.
C. If using Vacutainer collection, at least one other tube should be collected before collecting tubes for the test.
D. The collection tube must contain ~4.5 mL of blood. The plasma-to-anticoagulant ratio is critical. No short-sampled or overfilled tubes will be accepted.
E. Sample should be brought to the Hemostasis Lab immediately after collection, with time of collection marked on the label. If specimen cannot be delivered to the Lab immediately place on ice. If specimen is on ice for >4 hours, it will not be accepted for testing.
F. Specimen should be centrifuged immediately with top on tube at 2,500 g for 15 minutes (or adjusted speed/time to provide residual platelets of <10×10$^9$/L).
G. Using plastic dispo pipet, remove platelet-free plasma to plastic 12×75 tubes and cover.
H. If the assay cannot be performed within 4 hours, the plasma must be frozen at −20° C. (stable for 2 weeks) or −70° C. (stable for 6 months). Frozen plasma must be thawed rapidly in a 37° C. waterbath when ready to perform test.
I. Severely hemolyzed specimens will not be accepted for testing.

c) Equipment & Reagents

A. Equipment:
Stago-STA or other comparable automated coagulomator
Centrifuge
Pipettes
Pipette tips
Plastic test tubes
Cuvette roll (contains 1000 STA cuvettes)
Magnetic stir bars
Bar-coded Information sheet
Reagent grade water B. Reagents:
1. STA-Neoplastine-CI-Plus® Reagent (extrinsic pathway factor inhibitors)
   a. Reagent 1: STA-Neoplastin-CI-Plus® thromboplastin prepared from fresh rabbit cerebral tissues. The ISI value of this reagent is determined against a secondary standard known as the BCT (British comparative thromboplastin), and is indicated in the bar-code insert provided in the box.
   b. Reagent 2: Solvent containing calcium with sodium azide as a preservative, 10 mL per vial.
   c. Transfer reagent 2 into the vial of reagent 1 of same lot #. Swirl gently to obtain a homogeneous suspension. Keep the reconstituted reagent in the original vial and allow it to stand at room temperature (18-25° C.) for 30 minutes before use.
   d. Before placing the reagent on the instrument, remove rubber stopper, add a stir bar to the vial, and install the perforated plastic cap on the vial. The mixed reagent is stable 48 hours on the STA. Do not freeze.
2. PTT-A (intrinsic pathway factor inhibitors): reconstitute each vial with 5 mL of distilled water. Allow the reconstituted material to stand at room temperature for 30 minutes. Swirl the reagent gently, place a magnet inside, and install the perforated plastic cap on the vial. Vortex bottle before use. Stable for 24 hours on the STA. Do not freeze.
3. CaCL2 (0.025M); no reconstitution necessary. Stable for 5 days on the STA.
4. Sterile, filtered, distilled water.
5, Imidazole buffered saline: weigh in a 1 L volumetric flask 3.4 g imidazole and 5.85 g sodium chloride; add 186 mL 0 1 N hydrochloric acid, until pH is at 7.3 and qs to 1L with sterile water. The solution is stored at 2-8° C.
6. 0.1N HCl; measure 8 3 mL concentrated hydrochloric acid into a 1000 mL flask (volumetric) and qs to 1000 mL with sterile water. The solution is stored at 2-8° C.
7. Pooled normal plasma: George King pooled normal plasma-(unassayed)-George King Biomedical. Store frozen at −70° C. Thaw rapidly in 37° C. waterbath, vortex and keep cold until use.
8. Recombinant haplotype 1 human factor VIII (r-hFVIII-H1): dissolve a bottle of lyophilized r-hFVIII-H1 to a final concentration of 20 Units/mL with sterile filtered water. Example: if the concentration on the bottle is 475 Units (may vary)
   X mL=475 Units=23.75 mL
   20 Units/mL
   X=volume of sterile water to add to bottle to achieve 20 Units/mL
Distribute the reconstituted r-hFVIII-H1 via 125 pL aliquots into labeled cyrovials and freeze at −70° C. Stable indefinately under this storage condition. Thaw for 5 minutes at 37° C. in a waterbath immediately prior to using.
9. R-hFVIII-H1 plasma (1 Unit/mL): make this working solution by adding 504, of the stock r-hFVIII-H1 solution (20 Units/mL) to 9504, of immunodepleted FVIII deficient human plasma (i.e., NoFact-VIIIi; R²-Diagnostics, South Bend, Ind.; see below).
10. Recombinant haplotype 2 human factor VIII (r-hFVIII-H2): repeat procedure in step 8 above to reconstitute a vial of lyophilized r-hFVIII-H2 at 20 Units/mL
11. R-hFVIII-H2 plasma (1 Unit/mL): repeat procedure in step 9 above to prepare a working solution of r-hFVIII-H2 (20 Units/mL)
12. Repeat steps 8 and 9 individually four more times to prepare identical working solutions (20 Units/mL) of r-FVIII proteins representing the 4 additional haplotypic forms, H3, H4, H5 and H6, of the wildtype human FVIII protein (i.e., r-hFVIII-H3, r-hFVIII-H4, r-hFVIII-H5 and r-hFVIII-H6).
13. NoFact-VIIIi: immunodepleted FVIII-deficient plasma. Reconstitute each vial of NoFact-VIIIi FVIII-deficient plasma with 1.0 mL distilled water. Swirl gently and allow to stand for 20 minutes at room temperature. Stable 8 hours at 2-6° C.

d) Controls

A. System-N (normal): reconstitute with 1 mL of reagent grade water. Let sit for 30 minutes. Mix well. DO NOT INVERT. Stable for 8 hours on the STA.

B. System-P (abnormal): reconstitute in 1 mL of reagent grade water. Let sit 30 minutes. Mix well. DO NOT INVERT. Stable for 8 hours on the STA. System-N and -P are normal and abnormal controls that are set up to run automatically at 8-hour intervals. These should be performed at least once per shift if testing is performed. System-N and -P must be run any time that new reagent is made up. Control results are filed in the instrument's QC file automatically. All results for a 24-hour period will be reduced to a "mean" at midnight. This mean is used in the statistical data and is plotted on the Levy-Jennings chart.

C. Quality Control will automatically be run when a new calibration curve has been requested. If using a stored curve, the STA will automatically run QC if the patient samples have been loaded. QC can also be ordered manually before loading patient samples.

D. All control ranges are monitored automatically by the STA. If any controls are outside the ±2 SD range, the STA will audibly and visually alarm the operator. Otherwise, the results can be found in the AUTO CONTROL file and the individual QC files. Control results are automatically filed in the STA QC file. All results for a 24-hour period will be reduced to a "mean" value at midnight. This mean is used in the statistical data and is plotted on the Levy-Jennings chart as a daily mean.

e) Procedure

A. Dilute patient plasma in 12×75 plastic tubes with imidazole buffered saline as follows:

TABLE 1

Patient plasma dilution series.

| Dilution | Patient Plasma Dilution Series |
|---|---|
| 1:2 | 500 μL normal pooled plasma + 500 μL imidazole buffer saline |
| 1:4 | 500 μL of 1:2 patient dilution + 500 μL imidazole buffered saline |
| 1:8 | 500 μL of 1:4 patient dilution + 500 μL imidazole buffered saline |
| 1:16 | 500 μL of 1:8 patient dilution + 500 μL imidazole buffered saline |
| 1:32 | 500 μL of 1:16 patient dilution + 500 μL imidazole buffered saline |
| 1:64 | 500 μL of 1:32 patient dilution + 500 μL imidazole buffered saline |
| 1:128 | 500 μL of 1:64 patient dilution + 500 μL imidazole buffered saline |
| 1:256 | 500 μL of 1:128 patient dilution + 500 μL imidazole buffered saline |
| 1:512 | 500 μL of 1:256 patient dilution + 500 μL imidazole buffered saline |

B. To perform a haplotype-specific Bethesda assay, the following patient-specific medical history information must first be obtained or determined:

1. The wildtype FVIII background (H1, H2, H3, H4, H5, or H6) within which a patient's F8 mutation arose, and 2. Which FVIII replacement product(s) the patient has been administered. Currently there are 3 structurally-distinct r-FVIII proteins that are commercially available for clinical use in factor replacement therapy: (a) Kogenate (Bayer HealthCare, LLC; Berkeley, Calif.); (b) Recombinate (Baxter Healthcare Corporation; Westlake Village, Calif.); and (c) Refacto (Wyeth/Genetics Institute; St. Louis, Mo.). Kogenate is a full-length B-domain containing r-FVIII molecule that is identical at the amino acid sequence level to the naturally-occurring wildtype form of human FVIII represented by haplotype H1. Recombinate is a full-length, B-domain containing r-FVIII molecule that is identical in amino acid sequence to the naturally-occurring wildtype-form of human FVIII represented by haplotype H2. In contrast to Kogenate and Recombinate, Refacto is a non-naturally-occurring r-FVIII protein that lacks the majority of the B-domain found in the human molecule. Kogenate and Recombinatevary at only 1 amino acid residue, position 1241, i.e. the site of a naturally-occurring biallelic polymorphisms, D1241E, which is encoded by 1 (C92714G) of the 4 nsSNPs found in the human F8. Since Refacto lacks the B-domain, the location of D1241E, and has the same allele as Recombinate and Kogenate at the three additional nsSNP sites (i.e., R484H, R776G and M2238V), are refered to as representing a hybrid haplotype designated H1/H2.

3. In microvials, make the necessary number of incubation mixes between immuno-depleted FVIII-deficient human plasmas, which have first been reconstituted to contain a homogenous population of r-FVIII molecules that represent only 1 of the 6 naturally-occurring forms of the wildtype human protein (i.e., H1, H2, H3, H4, H5, or H6), and a dilution series of the patient's plasma (see tables 2 & 3 below). For any given patient, this will require the preparation of at least one r-FVIII working solution, which contains the form of the protein represented by what the patient has been treated with.

If, for example, a patient has only been treated with Kogenate (i.e., H1) and hisbackground FVIII haplotype is H1, only 1 reconstituted plasma working solution is prepared (i.e., FVIII-deficient human plasma containing 1 U/mL of r-hFVIII-H1) and used to prepare the 11 incubation mixtures with the patient's plasma as shown in Table 2 below.

If, however, the background haplotype of a patient, who, like the previous patient, has received only Kogenate, is H3, two reconstituted plasma working solutions must be prepared: (a) FVIII-deficient human plasma containing 1 U/mL of r-hFVIII-H1, as before; and (b) and FVIII-deficient human plasma containing 1 U/mL of r-hFVIIIH3 (to serve as a control). Testing in this patient requires that both of these FVIII working solutions would be used to prepare the 11 incubation mixtures with the patient's plasma as shown in Tables 2 and 3 below. In this case, the mixture of patient's plasma and the FVIII molecule corresponding structurally to what he has been treated with (r-hFVIII-H1), serves as the test mixture.

The test FVIII incubation mixtures for the patient discussed in the above example, would be prepared, as shown in table X below, by mixing 200 µL of the reagent FVIII-deficient human plasma (No-FactVIIIi)[1], that has first been reconstituted with r-hFVIII-H1 at 1 Unit/mL, with either 200 µL of non-diluted patient's plasma or 200 µL of the patient's plasma that has first been diluted imidazole buffered saline (see Table 1) as shown.

TABLE X

Test incubation mixtures for 1$^{st}$ & 2$^{nd}$ example patients described above.

| Tube | Test Incubation Mixtures |
|---|---|
| (−)-control | 200 µL normal pooled plasma + 200 µL imidazole buffer saline |
| 1:1 | 200 µL human plasma (r-hFVIII-H1) + 200 µL patient's non-diluted plasma |
| 1:2 | 200 µL human plasma (r-hFVIII-H1) + 200 µL patient's 1:2 plasma dilution |
| 1:4 | 200 µL human plasma (r-hFVIII-H1) + 200 µL patient's 1:4 plasma dilution |
| 1:8 | 200 µL human plasma (r-hFVIII-H1) + 200 µL patient's 1:8 plasma dilution |
| 1:16 | 200 µL human plasma (r-hFVIII-H1) + 200 µL patient's 1:16 plasma dilution |
| 1:32 | 200 µL human plasma (r-hFVIII-H1) + 200 µL patient's 1:32 plasma dilution |
| 1:64 | 200 µL human plasma (r-hFVIII-H1) + 200 µL patient's 1:64 plasma dilution |
| 1:128 | 200 µL human plasma (r-hFVIII-H1) + 200 µL patients 1:128 plasma dilution |
| 1:256 | 200 µL human plasm'a (r-hFVIII-H1) + 200 µL patient's 1:256 plasma dilution |
| 1:512 | 200 µL human plasma (r-hFVIII-H1) + 200 µL patient's 1:512 plasma dilution |

[1]No-FactVIIIi is generated by FVIII-immunodepletion of pooled normal human plasma

TABLE Y

Control incubation mixtures for 2$^{nd}$ example patient described above.

| Tube | Control Incubation Mixtures |
|---|---|
| (−)-control | 200 µL normal pooled plasma + 200 µL imidazole buffer saline |
| 1:1 | 200 µL human plasma (r-hFVIII-H3) + 200 µL patient's non-diluted plasma |
| 1:2 | 200 µL human plasma (r-hFVIII-H3) + 200 µL patient's 1:2 plasma dilution |
| 1:4 | 200 µL human plasma (r-hFVIII-H3) + 200 µL patient's 1:4 plasma dilution |
| 1:8 | 200 µL human plasma (r-hFVIII-H3) + 200 µL patient's 1:8 plasma dilution |
| 1:16 | 200 µL human plasma (r-hFVIII-H3) + 200 µL patient's 1:16 plasma dilution |
| 1:32 | 200 µL human plasma (r-hFVIII-H3) + 200 µL patient's 1:32 plasma dilution |
| 1:64 | 200 µL human plasma (r-hFVIII-H3) + 200 µL patient's 1:64 plasma dilution |
| 1:128 | 200 µL human plasma (r-hFVIII-H3) + 200 µL patient's 1:128 plasma dilution |
| 1:256 | 200 µL human plasma (r-hFVIII-H3) + 200 µL patient's 1:256 plasma dilution |
| 1:512 | 200 µL human plasma (r-hFVIII-H3) + 200 µL patient's 1:512 plasma dilution |

C. Mix the incubation mixtures, cap vials, place in the 37° C. waterbath and incubate for 2 hours.

D. At the end of 2 hours, perform the FVIII assay on the control tubes, the tube with the 1:1 dilution and the tube with the 1:2 dilution, on the STA as follows:

1. Refer to the START-UP procedure for the STA before running patient samples on the STA at the start of each shift.
2. Request quality control if using a stored curve: through the MAIN MENU under CALIB/CONTROL select QUALITY CONTROL and enter. Cursor to the selected factor assay(s) and select by pressing F1 and then F10 to run the QC.
3. Load patient samples: access the sample drawer(s) through the MAIN MENU under LOADING. After the drawer opens, identify the type of specimen, such as micro sample, with F8, or STAT, with F12. Identify the sample by bar-coding or manually entering on the keyboard the patient identification number and then placing the sample into the drawer.
4. In MANUAL MODE, the operator must order the test from the menu. Select the factor that has a X10 dilution. Press F10 to save.
5. As soon as the sample drawer closes, the TEST STATUS screen will appear. If there is not enough reagent(s) to run the test, the suspect reagent(s) will appear in red with the amount of deficiency. This deficiency will BLOCK the sample pipettor. When this occurs, add the deficient reagent(s) to run the samples.
6. All dilutions of the calibrator, controls and patient samples are automatically prepared by the STA according to the parameters entered in the Test Set-up. If the patient results fall outside the assay range, the STA automatically re-tests the sample in question at an appropriate dilution provided that the option has been entered in the Test Set-up.
7. All patient results are displayed on the TEST PANEL screen and automatically print out and transmit if selected.
8. For results in question that need operator intervention, cursor to the identification number in the TEST PANEL screen and enter. This will bring up the FILE PROCESSING screen. Follow the options in the left-hand corner of the screen, i.e. re-run test.

f) Procedural Notes

A. Calculate the residual FVIII:C activity of each patient dilution incubation mixture by using the following calculations:

$$\text{Residual } FVIII{:}C \text{ activity} = \frac{\text{Factor } VIII{:}C \text{ Activity (Patient)}}{\text{Factor } VIII{:}C \text{ Activity (Control)}} \times 100$$

B. If the residual FVIII:C activity level is <75%, the residual FVIII:C activity is converted to a Bethesda unit factor using the following chart and calculation:

Bethesda Factor Chart:

| Residual FVIII:C Level | Bethesda Units |
|---|---|
| 75% | 0.40 |
| 73% | 0.45 |
| 70% | 0.50 |
| 68% | 0.55 |
| 66% | 0.60 |
| 64% | 0.65 |
| 61% | 0.70 |
| 59% | 0.75 |
| 57% | 0.80 |
| 55% | 0.85 |
| 53% | 0.90 |
| 51% | 0.95 |
| 50% | 1.00 |
| 48% | 1.05 |
| 46% | 1.10 |
| 45% | 1.15 |
| 43% | 1.20 |
| 42% | 1.25 |
| 41% | 1.30 |
| 40% | 1.35 |
| 38% | 1.40 |
| 37% | 1.45 |
| 35% | 1.50 |
| 34% | 1.55 |
| 33% | 1.60 |
| 32% | 1.65 |
| 30% | 1.70 |
| 29% | 1.75 |
| 28% | 1.80 |
| 27% | 1.85 |
| 26% | 1.90 |
| 25% | 2:00 |

C. If the residual FVIII:C activity is >75% of the control value in the 1:1 dilution tube and the 1: dilution tube, report out <1.0 Bethesda unit.

D. Perform the following calculation to determine Bethesda units/mL plasma of inhibitor present using the residual FVIII:C value closest to 50% of the control value.

1. Calculation:

$$\text{Bethesda units factor from chart} \times \text{Dilution factor from chart} \\ \text{of patient plasma used to determine residual } FVIII{:}C = \\ FVIII{:}C \text{ inhibitor in Bethesda units/mL plasma}$$

DILUTION FACTOR CHART

| Dilution of Patient Plasma | Dilution Factor |
|---|---|
| 1:1 | 1 |
| 1:2 | 2 |
| 1:4 | 4 |
| 1:8 | 8 |
| 1:16 | 16 |
| 1:32 | 32 |
| 1:64 | 64 |
| 1:128 | 128 |
| 1:256 | 256 |
| 1:512 | 512 |

2. Example:
Control FVIII:C level=50%
Patient FVIII:C level on 1:4 dilution=25%

$$\text{Residual } FYI!' \text{ level} = \frac{25}{50} \times 100\% = 50\%$$

50% in Bethesda units (BU) from Bethesda factor chart (chart B)=1.0BU
1.0BU×4 (patient dilution)=4.0BU (final result)

E. If the residual FVIII:C activity falls below 25%, the test must be repeated using higher dilutions of patient plasma until at least one value of greater than 25%, residual FVIII:C activity is obtained.

F. If more than one dilution falls between the 25% and 75% residual FVIII:C activity range, the final result should be the average of all these results.

G. To search for weak inhibitors, a >ratio of patient to pooled normal plasma can be used in the incubation mixture. If 1 part pooled normal plasma and one part patient plasma do not give a satisfactory result, increase the amount of patient plasma to pooled normal plasma: add 0.5 mL patient plasma to 0 1 mL pooled normal plasma and incubate 2 hours at 37° C. At the end of the 2 hour incubation, perform a FVIII:C assay on the specimen and calculate the %-residual activity as before. Determine the Bethesda unit as before. Divide the Bethesda units obtained by 5 to obtain the Bethesda units actually present in the patient plasma.

g) Result Reporting

A. If residual FVIII:C activity level is greater than 75%, report as: No inhibitor present (Bethesda units<1.0).

B. If residual FVIII:C activity level is 75% or less, report as inhibitor present (Bethesda units/mL of plasma).

h) Interpretation

One Bethesda unit is described as the concentration of an antibody which produces a residual FVIII:C of 50%, in a precisely controlled incubation mixture that is maintained at 37° C. for 2 hours. It is stated as 1 unit of inhibitor/mL of plasma. This method is primarily intended for use in measuring inhibitors that occur in hemophiliacs. Very weak inhibitors may not be detected by this method. Nearly all patients in whom inhibitors develop have severe hemophilia A (FVIII:C of <1%). In most patients, the antibody persists for years and there is an anamnestic response after transfusion. As the inhibitor titer increases, the patient usually becomes less responsive to replacement therapy. In some patients, the antibody titer remains low and does not increase after replacement therapy. FVIII:C inhibitors occasionally develop in non-hemophiliacs who have previously received transfusions. If weak inhibitors can be detected and quantitated, then the course of such inhibitors can be evaluated and related to such factors as blood product therapy. In some patients, inhibitor strength progress' from the barely detectable to the potent. Some patients with potent inhibitors who are not exposed further to blood products may have barely detectable inhibitors later.

The following references are herein incorporated by reference in their entireties:

A. Children's Hospital Medical Center, Los Angeles, Calif.

B. Kasper, Carol K. and Pool, Judith G., Measurement of mild inhibitors in Bethesda Units. Thrombosis et. Diathesis: Haemorrhagia. 1975, Vol. 34, p. 875.

C. Kasper, Carol K. and Pool, Judith G., et al. A More Uniform Measurement of Factor VIII inhibitors. Thrombosis et. Diathesis: Haemorrhagica. 1975 Vol. 34, p. 869.

D. Thomson, Jean M., ed. Blood Coagulation and Haemostasis: A Practical Guide. 2nd ed., Edinburgh, Great Britain, 1980, pp. 82-82.

E. Triplett, Douglas A., ed. Laboratory Evaluation of Coagulation. 1st ed., Chicago, Ill., 1981, pp. 128-129.

F. Triplett, Douglas A., and Harms, Cathy S. Procedures for the Coagulation Laboratory. Chicago, Ill., 1981, pp. 71-75.

G. Lusher, J., Abildgaard, C., Arkin, S, Mannucci, P. M., Zimmermann, R., Schwartz, L., Hurst, D. Human recombinant DNA-derived antihemophilic factor in the treatment of previously untreated patients with hemophilia A: final report on a hallmark clinical investigation. J. Thromb. Haemost. 2(4):574-83, 2004.

H. Lindgren, A., Wadenvik, H., and Tengborn, L. Characterization of inhibitors to FVIII with an ELISA in congenital and acquired haemophilia A. Haemophilia. 8(5): 644-648, 2004.

4. Methods of Genetic Testing

Rapid-cycle polymerase chain reaction (PCR) with an allele-specific fluorescent probe can be used for SNP genotyping. High-resolution amplicon melting curve analysis can be used for SNP genotyping. Fluorescent resonance energy transfer (FRET) hybridization probes for detection of the base changes (Lyon Molecular Diagnosis 1998 3:203, herein incorporated by reference) can also be used for SNP genotyping.

a) Lightcycler®

(1) Method

A method for determining a subject haplotype can combine a rapid-cycle polymerase chain reaction (PCR) with an allele-specific fluorescent probe melting for mutation detection. This method combined with rapid DNA extraction, can generally provide results within 60 min after receiving a blood sample. This method allows for easy, reliable, and rapid detection of a polymorphism, and is suitable for typing both small and large numbers of DNA samples.

The LightCycler® system enables the detection of single nucleotide polymorphisms. It combines PCR amplification and detection into a single step. The platform enables the real-time detection of a specific PCR product followed by melting curve analysis of hybridization probes. The technology is based on the detection of two adjacent oligonucleotide probes, whose fluorescent labels communicate through fluorescence resonance energy transfer (FRET). The molecular concept of single nucleotide polymorphism (SNP) detection is as follows: one of the probes serves as a tightly bound 30 anchor probe and the adjacent sensor probe spans the region of sequence variation. During the melting of the final PCR product, the sequence alteration is detected as a change in the melting temperature of the sensor probe. For a typical homozygous wild type sample, a single melting peak is observed; for mixed alleles, two peaks are observed; and for a homozygous mutated sample, a single peak at a temperature different from the wild type allele is observed. The temperature shift induced by one mismatched base is usually between 5 and 9° C. and easily observable.

The FVIII haplotyping assay allows the rapid detection and genotyping of four non-synonymous single nucleotide polymorphisms (nsSNPs) of the (G to A at cDNA position 1508, A to G at cDNA position 2383, G to C at cDNA position 3780, and A to G at cDNA position 6769), from DNA isolated from human whole peripheral blood. The test can be performed on the LightCycler® Instrument utilizing polymerase chain reaction (PCR) for the amplification of F8 DNA recovered from clinical samples and fluorigenic target-specific hybridization for the detection and genotyping of the amplified F8 DNA. Disclosed are oligonucleotides comprising cDNA sequences for each haplotype: H1 (SEQ ID NO: 7), H2 (SEQ ID NO: 8), H3 (SEQ ID NO: 9), H4 (SEQ ID NO: 10), H5 (SEQ ID NO: 11), H6 (SEQ ID NO: 12).

The FVIII haplotyping test is an in vitro diagnostic test for the detection and genotyping of four non-synonymous human F8 SNPs—which have common minor alleles conferring the amino acid substitutions R484H, R776G, E1241D and M2238V—whose naturally-occurring allelic combinations (i.e., haplotypes H1, H2, H3, H4, H5, and H6) encode six structurally distinct wildtype forms of the human FVIII protein. Because only two of these haplotypes, H1 and H2, are represented by the currently available recombinant1 and plasma-derived2 FVIII preparations used clinically, the FVIII haplotyping test will aid physicians select matched3 FVIII replacement products that reduce the frequency at which their hemophilia A patients develop FVIII inhibitors and immunologic refractoriness to replacement therapy.

Use of the FVIII haplotyping test as a component assay in laboratory algorithms for thrombophilia evaluation, can improve the diagnostic accuracy of thrombosis risk assessment, since the findings of recent genetic studies have demonstrated that the alleles of at least one of the these four nsSNPs F8 (i.e., D1241E) are functionally distinct and influence circulating FVIII levels. For example, because individuals with the E-allele (protein level; or G at the nucleotide level), were found to have an ~25% lower mean circulating FVIII level, than those with the more prevalent D-allele (protein level; or C at the nucleotide level), this SNP is a determinant of thrombosis risk at the population level. The test is performed on the LightCycler® Instrument (In the EU: serial number 2021 to 5602) using SW 3.5. The sample preparation is performed according to the procedure described below.

The development of neutralizing alloantibodies to replacement coagulation factor (F)VIII is a serious complication in the management of hemophilia A. The pathogenesis of these antibodies, termed inhibitors, is complex and incompletely understood. Through DNA sequencing, four common nonsynonymous single nucleotide polymorphisms (nsSNPs) were identified in the FVIII genes (F8) from 137 unrelated healthy people representing seven ethnic groups and identified. The naturally-occurring allelic combinations of these four nsSNPs were further found to encode six structurally-distinct wildtype FVIII proteins (haplotypes). This finding that FVIII is not monomorphic in man raises the possibility that structural differences between the background haplotype of a patient's endogenous molecule and the infused wildtype replacement FVIII protein(s) may contribute to the development of inhibitors.

African American (AA) hemophilia A patients experience a two-fold greater incidence of inhibitors in comparison to Caucasians. African Americans express five haplotypes of FVIII, designated H1, H2, H3, H4 and H5. In contrast, Caucasians express only H1 and H2. The recombinant FVIII molecules in replacement products used clinically have sequence identity with H1 and H2. Similarly, plasma-derived FVIII preparations marketed in the US are essentially highly enriched with the H1 and H2 forms of the protein, because the blood donor population is predominantly Caucasian. The H4 haplotype, expressed by ~4% of African Americans, is defined by the nsSNP R484H, which is located in an immunodominant epitope within the A2-domain. Two other haplotypes, H3 and H5, which together are expressed in ~23% of African Americans, have the minor allele of M2238V, a nsSNP in the C2-domain immunodominant epitope. These findings indicate that >25% of African American hemophilia A patients are treated with replacement products containing FVIII molecules which vary from their own at the hemophilic mutation site, and at one or more additional sites, with one always located in an dominant inhibitory epitope.

The use of this assay can guide hemophilia treaters in selecting FVIII replacement products that are matched as closely as possible to a given patient's endogenous background haplotype, which he will presumably have tolerance to, in order to reduce the frequency of inhibitor development.

Four fragments of the FVIII gene, referred to as amplicon-1 (189-bp), -2 (161-bp), -3 (151-bp), and -4 (163-bp), are individually amplified in separate PCRs from human genomic DNA using the four pairs of F8 specific primers listed above.

The amplicons, each of which contain one of the four F8 nsSNPs, are detected by fluorescence using a specific pair of hybridization probes (SEQ ID NOS: 27 & 28 for amplicon 1; SEQ ID NOS: 31 & 32 for amplicon 2; SEQ ID NOS: 35 & 36 for amplicon 3; and SEQ ID NOS: 39 & 40 for amplicon 4). The paired hybridization probes comprise two different oligonucleotides that hybridize to an internal sequence of the amplified F8 fragment during the annealing phase of the PCR cycle. One probe is labeled at the 5'-end with LightCycler® Red 640, and to avoid extension, modified at the 3'-end by phosphorylation. The other probe is labeled at the 3'-end with fluorescein.

Only after hybridization to the template DNA, do the two probes come in close proximity, resulting in fluorescence resonance energy transfer (FRET) between the two fluorophores. During FRET, fluorescein, the donor fluorophore, is excited by the light source of the LightCycler® Instrument, and part of the excitation energy is transferred to LightCycler® Red 640, the acceptor fluorophore.

The emitted fluorescence of LightCycler® Red 640 is then measured by the LightCycler® Instrument.

Genotyping: The paired hybridization probes are also used to determine the nsSNP genotype contained within the amplicon by performing a melting curve analysis after the amplification cycles are completed and the amplicon is present at increased concentration.

In amplicons 2 and 4, the LightCycler® Red 640-labeled hybridization probe hybridizes to a part of the target sequence that is not polymorphic and functions as an anchor probe. In amplicons 1 and 3, the LightCycler® Red 640-labeled hybridization probe hybridizes to a part of the target sequence that spans the SNP site (SNP probe).

The Fluorescein-labeled hybridization probe hybridizes to a part of the target sequence in amplicons 2 and 4 that is polymorphic and functions as the SNP probe. In amplicons 1 and 3, it hybridizes to a part of the target sequence that is not polymorphic and functions as an anchor probe.

During the melting curve analysis of amplicons 1 and 3, increasing temperature causes the fluorescence to decrease because the LightCycler® Red 640-labeled hybridization probe, the shorter of the two probes (SNP probe) dissociates first and the two fluorescent dyes are no longer in close proximity. During the melting curve analysis of amplicons 2 and 4, in contrast, the increasing temperature causes the fluorescence to decrease because the Fluorescein-labeled hybridization probe, the shorter of the two probes (SNP probe) dissociates first and the two fluorescent dyes are no longer in close proximity.

For both amplicon 2 and 4, if the more frequent A-allele is present at the site of nsSNP #2 (A2383G [R776G]) or nsSNP #4 (A6769G [M2238V]), respectively, the mismatch of the SNP probe with the target sequence destabilizes the hybrid so the decrease in fluorescence will occur at a lower temperature. For amplicon 1, if the less frequent A-allele is present at the nsSNP #1 site (G1508A [R48411]), the mismatch of the SNP probe with the target sequence destabilizes the hybrid so the decrease in fluorescence will occur at a lower temperature. Likewise, for amplicon 3, if the less frequent G-allele4 is present at the nsSNP #3 site (C3780G [D1241E]), the mismatch of the SNP probe with the target sequence destabilizes the hybrid so the decrease in fluorescence will occur at a lower temperature. With the less frequent G-allele present at the site of either nsSNP #2 (amplicon 2) or nsSNP #4 (amplicon 4), or the more frequent G- or C-alleles at the site of either nsSNP #1 (ampliconl) or nsSNP #3 (amplicon 3), the genotype mismatches will not occur, and therefore the heteroduplex has a higher melting temperature (Tm). The heterozygous genotype at all four nsSNPs exhibits a distinctive combination of properties.

(2) Primers/Probes

Disclosed herein are four sets of oligonucleotide sequences (i.e., each set contains a PCR primer set and a FRET probe set) used as the reagents in the LightCycler/Hybridization Probe Analysis-based assay to rapidly genotype the four nsSNPs in the F8 gene of a given individual, and therefore to define their FVITE haplotype. These oligonucleotides (i.e., both primers and probes) are named according to the nucleotide position corresponding to the major transcriptional start of the F8 gene, found in SEQ ID NO:1, as well as the five other F8 gene sequences (i.e., SEQ ID NO:2; SEQ ID NO:3; SEQ ID NO:4; SEQ ID NO:5; SEQ ID NO:6), which corresponds to nucleotide position 1001. This site (i.e., nucleotide position 1001 in the F8 gene sequences) can also be correlated with the a single precise nucleotide position within the GenBank human F8 reference sequence (accession number is NG_005114). The human F8 transcriptional start site sequence corresponds precisely with nucleotide position 465,469 in the complementary strand to that contained within NG_005114.

(a) nsSNP# 1: (G61620A/G1508A/R484H)
H-F8-61568-F (forward):

(SEQ ID NO: 25)
5'-AATCAAGCAAGCAGACCAT

H-F8-61756-R (reverse):

(SEQ ID NO: 26)
5'-GGCCAACAGCTGGAGAA

H-F8-61629 (probe 1):

(SEQ ID NO: 27)
5'-LC$^{Red640}$-TACAAAGGACGGACATCAGTGATTCCG-phosphate

H-F8-61666 (probe 2):

(SEQ ID NO: 28)
5'-ATCGAGGGAATATTTACCTTTTGGTAATCTCCTTG-Fluorescein (b) nsSNP# 2: (A91317G/A2383G/R776G)
H-F8-91221-F (forward):

(SEQ ID NO: 29)
5'-CAGAATTCAAGACACCCTAGC

H-F8-91381-R (reverse):

(SEQ ID NO: 30)
5'-CTCTGTCGCAAGAGCATC

H-F8-91298 (probe 1):

(SEQ ID NO: 31)
5'-LC$^{Red640}$-AGTCTTCTCTATGTCATTTTCTGGAATTGTGGTGG-phosphate

-continued

H-F8-91320 (probe 2):
(SEQ ID NO: 32)
5'-TTCCGTGTGCAAACCAAGGG-Fluorescein (c) nsSNP# 3: (C92714G/C3780G/D1241E)
H-F8-92624-F (forward):
(SEQ ID NO: 33)
5'-GCCTCAGATACATACAGTGAC H-F8-92774-R (reverse):
(SEQ ID NO: 34)
5'-TGTTCTATTTGTTGAATCATTTAATGACC H-F8-92670 (probe 1): 5
(SEQ ID NO: 35)
5'-CTTTTCTTACTGAGCACTAGGCAAAATGTAGAAGG-Fluorescein H-F8-92707 (probe 2):
(SEQ ID NO: 36)
5'-LC$^{Red640}$-CATATGACGGGGCATATGCTCCA-phosphate (d nsSNP# 4: (A162161G/A6769G/M22380V)
H-F8-162073-F (forward):
(SEQ ID NO: 37)
5'-AATGGTGACCAAGAGGC H-F8-162235-R (reverse):
(SEQ ID NO: 38)
5'-GATGAGGAACTCCTTCACATAC H-F8-162136 (probe 1):
(SEQ ID NO: 39)
5'-LC$^{Red640}$-CCACTCTTTTGGATTATTCACCTGAGGGCAATAGA-phospate H-F8-162166 (probe 2):
(SEQ ID NO: 40)
5'-TTTCACTGTCTTCTGGAAGTCCACTTGC-Fluorescein b) High-Resolution Amplicon Melting Curve Analysis Disclosed are methods for determining a subject haplotype utilizing high-resolution amplicon melting curve analysis.

(1) Method

There are many methods available to genotype SNPs. Available methods that require a separation step include restriction fragment length polymorphism analysis, single-nucleotide extension, oligonucleotide ligation, and sequencing.

Homogeneous, closed-tube methods for SNP genotyping that do not require a separation step are attractive for their simplicity and containment of amplified products. Most of these methods are based on PCR. Melting curve analysis in conjunction with real-time PCR was introduced in 1997 (Ririe Anal. Biochem 1997 245:154), incorporated herein by reference. The ds DNA dye SYBR Green I was used for amplicon melting analysis and provided a rough characterization of what was amplified. Subsequently, hybridization probes were used to interrogate a limited region of the amplicon for sequence differences by melting curve analysis (Lay Clin Chem 1997 43:2262), incorporated herein by reference. The primary advantage of this method or other real-time PCR methods is that it can interrogate the entire region under the probe, rather than just detecting the presence or absence or a specific allele. Two hybridization probes are most commonly used for melting curve analysis of small sequence variations.

If PCR is done with a 5'-labeled primer, high resolution melting analysis can distinguish different homozygotes and heterozygotes (Gundry Clin Chem 2003 49:396), incorporated herein by reference. The disadvantages of this method are the requirements of a labeled primer and that the sequence variations must be within the melting domain that includes the labeled primer.

SYBR Green I has limitations for detection of small sequence variations. Detection of heterozygotes by melting curve analysis with SYBR Green I has been possible only when extra steps are added between amplification and analysis, such as amplicon purification and addition of high amounts of the dye (Lipsky Clin Chem 2001 47:635), incorporated herein by reference, or urea (Elenitoba-Johnson Am J Pathol 2001 159:845), incorporated herein by reference. Wittwer et al (Clin Chem 2003 49:6), incorporated herein by reference, screened several ds DNA dyes and found one, LCGreen I, that did detect heterozygotes, but did not inhibit or otherwise adversely affect PCR amplification. Unlike SYBR Green I, LC Green I saturates PCR products without inhibiting amplification and does not redistribute as the amplicon melts.

High resolution melting of PCR amplicons with LCGreen I was recently introduced as a homogeneous, closed-tube method for rapid SNP genotyping that does not require the use of probes. Genomic DNA is amplified in the presence of LCGreen I in LightCycler (Roche Applied Science) capillary tube. The capillary tube is then transferred to a high-resolution melting instrument (HR-1, Idaho Technology) for the melting curve acquisition and analysis. The instrument surrounds the capillary tube with an aluminum cylinder that is heated by a coil wound around the outside. Sample temperature and fluorescence signals are converted to 16-bit digital signals, providing resolution down to 0.002° C. and 0.002% normalized fluorescence. Approximately 50 data points are acquired for every 1° C. The melting curve acquisition requires only 1 to 2 min. Melting data are analyzed with the KR-1 instrument software. Fluorescence values are normalized between 0% and 100% by first defusing linear baselines before and after the melting transition of each sample. Within each sample, the fluorescence of each acquisition is calculated as the percentage of fluorescence between the top and bottom baselines at each acquisition temperature. Heterozygotes are identified by a change in melting curve shape, and different homozygotes are distinguished by a change in melting temperature (Tm).

When coupled with rapid cycle PCR, SNP genotyping can be performed in 30 minutes or less. Although LightCycler real-time PCR instruments are commonly used in research and molecular diagnostic laboratories for melting curve analysis, the resolution of real-time PCR instruments is limited and they cannot distinguish the small Tm differences between homozygotes. Dedicated melting instruments have recently become available. Although only one sample at a time is analyzed the analysis time is so short (1 to 2 min) that the throughput is relatively high.

High-resolution melting of small PCR amplicons (<50 bp) is simple, rapid, and inexpensive method for SNP genotyping. Engineered plasmids representing all of the possible SNP base changes, and samples containing the medically important factor V (Leiden) 1691 G>A, prothrombin 20210G>A, methylenetetrahydrofolate reductase 1298A>C, hemochromatosis 187C>G, and β-globin (hemoglobin S) 17A>T were successfully genotyped using this method (Liew Clin Chem 2004 50:7), incorporated herein by reference. In all cases, heterozygotes were easily identified because the heteroduplexes altered the shape of the melting curves. Approximately 84% of human SNPs involve a base exchange between A:T and G:C base pairs (Venter Science 2001 291:1304), and the homozygotes are easily genotyped by Tms that differ by 0.8 to 1.4° C. However in the remaining SNPs, the bases only switch strands and preserve the base pair, producing very small Tm differences between homozygotes (<0.4° C.). Although most of these cases can still be genotyped by Tm, about a quarter have nearest neighbor symmetry (complementary bases), and the homozygotes cannot be distinguished. In these cases adding a known homozygous genotype to unknown samples allows melting curve separation of all three genotypes. This method was used to identify C/C and G/G homozygotes in the hemachromatosis 187C>G SNP genotyping assay mentioned above (Liew Clin Chem 2004). This represents the worst case scenario, since the nearest neighbors of this SNP were complementary bases (A and T). When the bases flanking the SNP are symmetrical, the nearest neighbor stability calculations are nearly identical.

Disclosed herein is the use of high-resolution melting curve analysis in assays for the four F8 nsSNPs (G61620A, G92714C, A162161G & A91317G) whose naturally occurring allelic combinations (haplotypes) encode the 6 different wildtype forms of FVIII in humans.

| Correlation of nsSNP genotypes with FVIII haplotype | | | | |
|---|---|---|---|---|
| nsSNP no. | 1(G61620A) | 2(A91317G) | 3(G92714C) | 4(A162161G) |
| Haplotype 1 | G | A | C | A |
| Haplotype 2 | G | A | G | A |
| Haplotype 3 | G | A | G | G |
| Haplotype 4 | A | A | G | A |
| Haplotype 5 | G | A | C | G |
| Haplotype 6 | G | G | G | A |

DNA from whole blood samples can be extracted using a MagNA Pure instrument with a total nucleic acid kit. As Tm is strongly dependent on the ionic strength, it is important that samples are extracted in the same way and end up in the same buffer. Using this automated extraction system ensures uniformity in technique and nucleic acid yield.

To maximize the Tm differences between the genotypes, the amplicons can be made as short as possible (<50 bp). The sequence information surrounding the SNP will can be entered into computer software ("SNPWizard" at DNAWizards.path.utah.edu). The 3' end of each primer can be placed immediately adjacent to the SNP and its length increased in its 5' direction until its predicted Tm is as close to 55-60° C. as possible. The primer pair can then be checked for the potential to form primer dimers or other non-specific amplicons. If alternative products are likely, then the 3'end of one primer can be shifted one base away from the SNP and the process can be repeated until an acceptable pair is found. Candidate primer pairs can be synthesized using standard phosphoramidite chemistry.

Separate PCRs for each SNP can be performed in 10 µl volumes with the following reaction constituents: dNTPs (200 µM), KlenTaql polymerase (0.4 U), TaqStart antibody (88 ng), forward and reverse primers (250 nM each), LC Green I (1×), MgCl2 (3 mM), Tris buffer pH 8.3 (50 mM), and 1 µL DNA sample. Thermal cycling can be performed in a LightCycler real-time PCR instrument. Rapid thermal cycling can be performed between 85° C. and the annealing temperature at the programmed transition rate of 20° C./sec. Amplified samples can be heated to 94° C. in the LightCycler and rapidly cooled to 40° C. The LightCycler capillaries can then be transferred to the HR-1 instrument and heated at 0.3° C./sec. Samples can be analyzed between 65 and 85° C. with the instrument software. Fluorescence vs. temperature plots can be normalized as described above.

The ability of the high-resolution melting analysis to correctly identify the 4 informative SNPs and assign 6 Factor VIII haplotypes can be assessed with a set of samples authenticated by nucleic acid sequencing.

High-resolution melting can correctly identify SNP genotypes 1, 2, and 4 since they all represent transitions of G and A. High-resolution melting can correctly identify SNP genotype 3 as the G and C is simply inverted, that is, the bases switch strands but the base-pair remains the same. Differences in amplicon Tm still result from different nearest-neighbor interactions but they are usually small. However, SNP 3 is flanked by noncomplementary bases (A and G) and results in small but distinguishable change in Tm for the amplicon containing base inversion.

(2) Primers

Four oligonucleotide primer pairs (i.e., 8 total oligonucleotides) required to utilizing the method known as "High-Resolution Amplicon Melting-Curve Analysis" to genotype the 4 nsSNPs in the FVIII gene (F8) whose naturally-occurring allelic combinations encode the 6 distinct wild-type forms of the FVIII protein in humans.) The following four pairs of oligonucleotide sequences that represent the four primer pairs used in the PCR/High-Resolution Amplicon Melting-Curve-Analysis-based assay enable rapid genotyping of the 4 nsSNPs in the F8 gene of a given individual, and therefore to define their FVIII haplotype. These oligonucleotides are named according to the nucleotide position corresponding to the major transcriptional start of the F8 gene, which corresponds to nucleotide position 1001 of SEQ ID NO:1, as well as to nucleotide position 1001 in the five other F8 gene sequences (i.e., SEQ ID NO:2; SEQ ID NO:3; SEQ ID NO:4; SEQ ID NO:5; SEQ ID NO:6). This site (i.e., nucleotide position 1001 in the F8 gene sequences) can also be correlated with the a single precise nucleotide position within the GenBank human F8 reference sequence (accession number is NG_005114). The human F8 transcriptional start site sequence corresponds precisely with nucleotide position 465,469 in the complementary strand to that contained within NG_005114.

(a) nsSNP #1

G61620A (R484H): the minor allele of this nsSNP (i.e., which is an "A" at the nucleotide level and a "histidine" [H] at the amino acid level) is restricted to African-Americans.

```
A61620 (R484H)
H-F8-61599-F (forward primer):
                                (SEQ ID NO: 41)
5'-CTCACGGAATCACTGATGTC H-F8-61643-R (reverse primer):
                                (SEQ ID NO: 42)
5'-GTAATCTCCTTGAATACAAAGG
``` nsSNP #1 forward genotyping primer Melting temperature (Tm): 40+20=60° C.
nsSNP #1 reverse genotyping primer Melting temperature (Tm): 40+20=60° C.

(b) nsSNP #2

A91317G (R776G): the minor allele of this nsSNP (i.e., which is a "G" at the nucleotide level and a "Glycine" [G] at the amino acid level) is restricted to Chinese individuals

```
G91317 (R776G)
H-F8-91298-F (forward primer):
                                (SEQ ID NO: 43)
5'-TGACCCTTGGTTTGCACAC H-F8-91339-R (reverse primer):
                                (SEQ ID NO: 44)
5'-TGTATTTTAGGCATAGGTGTTC
``` nsSNP #2 forward genotyping primer Melting temperature (Tm): 40+18=58° C.
nsSNP #2 reverse genotyping primer Melting temperature (Tm): 32+28=60° C.

(c) nsSNP #3

G92714C (E1241D): the minor allele of this nsSNP (i.e., which is a "C" at the nucleotide level and a "aspartate" [D] at the amino acid level) is not restricted ethnically (Note that while C is the minor allele in the African-American population, in all other human populations, including Caucasians, it is the opposite with the "G" nucleotide and "Glutamate" [E] being the minor allele).

```
C92714 (E1241D)
H-F8-92691-F (forward primer):
                              (SEQ ID NO: 45)
5'-CAAAATGTAGAAGGTTCATATGA H-F8-92738-R (reverse primer):
                              (SEQ ID NO: 46)
5'-TTGAAGTACTGGAGCATATGC
``` nsSNP #3 forward genotyping primer Melting temperature (Tm): 28+32=60° C.
nsSNP #3 reverse genotyping primer Melting temperature (Tm): 36+24=60° C.

(d) nsSNP #4

A162161G (M2238V): the minor allele of this nsSNP (i.e., which is a "G" at the nucleotide level and a "valine" [V] at the amino acid level) is restricted to African-Americans.

```
G162161 (M2238V)
H-F8-162141-F (forward primer):
                              (SEQ ID NO: 47)
5'-AAGTGGACTTCCAGAAGACA H-F8-162182-R (reverse primer):
                              (SEQ ID NO: 48)
5'-TAGTTACTCCTGTGACTTTCA
``` nsSNP #4 forward genotyping primer Melting temperature (Tm): 36+22=58° C.
nsSNP #4 reverse genotyping primer Melting temperature (Tm): 32+26=58° C.

c) Functional Scan (1) Method

See Example 2 for a discussion of an exemplary functional varation scan.

(2) Primers

Disclosed herein are 39 pairs of oligonucleotides used for scanning the functional regions of the human F8 gene in order to find naturally-occurring sequence variation that are candidates to have functionally distinct alleles that can influence thrombosis risk (for example, the D1241E nsSNP, because the D-allele is associated with a significantly higher mean FVIII levels than the E-allele) (See Example 2, below). However because it also changes an amino acid in a protein that is used as a therapeutic replacement molecule that is naturally immunogenic, they can also influence the immune response to treatment depending upon which allele a patient has and which allele they are treated with.

The SEQ ID's of the F8 gene sequences disclosed are used as the basis to name and thus define the exact position of the oligonucleotide sequences below, which as mentioned above, are the 39 primer pairs necessary for both amplifying and sequencing the F8 gene.

The nucleotide numbering scheme used for the F8 gene described in SEQ ID No's 1-6 (and therefore for the oligonucleotides) is based on the major transcriptional start of the F8 gene (i.e., the 5'-end of the predominant mRNA species for transcribed from the F8 gene), which corresponds to nucleotide position 1001 of SEQ ID NO:1, as well as to nucleotide position 1001 in the 5 other F8 gene sequences (i.e., SEQ ID NO:2; SEQ ID NO:3; SEQ ID NO:4; SEQ ID NO:5; SEQ ID NO:6). This site (i.e., the transcriptional start or nucleotide position 1001 in the F8 gene sequences) can also be correlated with the a single precise nucleotide position within the GenBank reference sequence for the human F8 gene whose accession number is NG_005114. Since the sequence contained within NG_005114 represents the antisense strand of the F8 gene, the transcriptional start site corresponds precisely with nucleotide position 465,469 in the complementary strand to that contained within NG_005114.

| Primer Name: | Sequence: | | Amplicon: |
|---|---|---|---|
| hF8-(-1214)-F | 5'-TTATCAAAGGGGCTTCTTGC-3' | (SEQ ID NO: 49) | A01 |
| hF8-(-573)-R | 5'-CATGCCCTTTCTCCTGACC-3' | (SEQ ID NO: 50) | A01 |
| hF8-(-683)-F | 5'-AGCAAGTGTTGAGGTCCAGG-3' | (SEQ ID NO: 51) | A02 |
| hF8-(-56)-R | 5'-TGAAGTAGCAAAAGGGAGGC-3' | (SEQ ID NO: 52) | A02 |
| hF8-(-168)-F | 5'-CTTCTCCATCCCTCTCCTCC-3' | (SEQ ID NO: 53) | A03 |
| hF8-441-R | 5'-CAGAAATGTTTCTTTGGGGC-3' | (SEQ ID NO: 54) | A03 |
| hF8-23012-F | 5'-CTTCAAATTTGCCTCCTTGC-3' | (SEQ ID NO: 55) | A04 |
| hF8-23436-R | 5'-AGACCAAGCAGAGGAAGACG-3' | (SEQ ID NO: 56) | A04 |
| hF8-25450-F | 5'-AATCTTGCCTCAGAGCAACC-3' | (SEQ ID NO: 57) | A05 |
| hF8-26066-R | 5'-GAAAAGCAATTCCTAGGGGG-3' | (SEQ ID NO: 58) | A05 |
| hF8-29413-F | 5'-GGGCAACAGAGTGAGACTCC-3' | (SEQ ID NO: 59) | A06 |
| hF8-30016-R | 5'-TTCTGGAACTCAGCTCCTCC-3' | (SEQ ID NO: 60) | A06 |
| hF8-35266-F | 5'-GGAGACCTGACATCAAAGCC-3' | (SEQ ID NO: 61) | A07 |

-continued

| Primer Name: | Sequence: | Amplicon: |
|---|---|---|
| hF8-35608-R | 5'-AACCCCATCTCCTTCATTCC-3' (SEQ ID NO: 62) | A07 |
| hF8-37821-F | 5'-TAAGGTGTGAGCACACTGGG-3' (SEQ ID NO: 63) | A08 |
| hF8-38404-R | 5'-CGATGAGTTCTGTTCTGAGCC-3' (SEQ ID NO: 64) | A08 |
| hF8-52986-F | 5'-ATGGTGATTGGTGACCTTGG-3' (SEQ ID NO: 65) | A09 |
| hF8-53544-R | 5'-GGAAACTAGGGGATCTTGGC-3' (SEQ ID NO: 66) | A09 |
| hF8-55802-F | 5'-GTCTTGCTCCTGCTTTCACC-3' (SEQ ID NO: 67) | A10 |
| hF8-56428-R | 5'-TACCCTTGCCATTTGATTCC-3' (SEQ ID NO: 68) | A10 |
| hF8-56244-F | 5'-CTGCTGAAGAGGAGGACTGG-3' (SEQ ID NO: 69) | A11 |
| hF8-56855-R | 5'-ATGTCCATTGGAGACAAGGC-3' (SEQ ID NO: 70) | A11 |
| hF8-61345-F | 5'-GATTGTGGTATCTGCAGGGG-3' (SEQ ID NO: 71) | A12 |
| hF8-61753-R | 5'-CAACAGCTGGAGAAAGGACC-3' (SEQ ID NO: 72) | A12 |
| hF8-65333-F | 5'-TGACACTTTCACAGTCAACCG-3' (SEQ ID NO: 73) | A13 |
| hF8-65920-R | 5'-CAGCAGGCACGTTTACTACG-3' (SEQ ID NO: 74) | A13 |
| hF8-68456-F | 5'-CAGTCACCCTCTTGTCCTGG-3' (SEQ ID NO: 75) | A14 |
| hF8-69067-R | 5'-GGGAATTAAAAGGGAGAGGG-3' (SEQ ID NO: 76) | A14 |
| hF8-74699-F | 5'-CCTGGGAATAAGATAATGGGC-3' (SEQ ID NO: 77) | A15 |
| hF8-75338-R | 5'-AAATGCTGGTGAGGATGTGG-3' (SEQ ID NO: 78) | A15 |
| hF8-90867-F | 5'-ACAGCAGCAATGCAAAAACC-3' (SEQ ID NO: 79) | A16 |
| hF8-91468-R | 5'-TCTATTGCTCCAGGTGATGG-3' (SEQ ID NO: 80) | A16 |
| hF8-91365-F | 5'-ATGCTCTTGCGACAGAGTCC-3' (SEQ ID NO: 81) | A17 |
| hF8-91942-R | 5'-AACAAAGCAGGTCCATGAGC-3' (SEQ ID NO: 82) | A17 |
| hF8-91756-F | 5'-TTGGCAAAAAGTCATCTCCC-3' (SEQ ID NO: 83) | A18 |
| hF8-92379-R | 5'-TAATTGCTTTGGACTGGGG-3' (SEQ ID NO: 84) | A18 |
| hF8-92247-F | 5'-CCACCAGATGCACAAAATCC-3' (SEQ ID NO: 85) | A19 |
| hF8-92850-R | 5'-TTTGCTTGGTTTGATTTCCC-3' (SEQ ID NO: 86) | A19 |
| hF8-92700-F | 5'-GAAGGTTCATATGACGGGGC-3' (SEQ ID NO: 87) | A20 |
| hF8-93290-R | 5'-ATGACTGCTTTCTTGGACCCC-3' (SEQ ID NO: 88) | A20 |
| hF8-93200-F | 5'-TCTGACCAGGGTCCTATTCC-3' (SEQ ID NO: 89) | A21 |
| hF8-93816-R | 5'-CATGATTGCTTTCACAAGCG-3' (SEQ ID NO: 90) | A21 |
| hF8-93674-F | 5'-ATTGGATCCTCTTGCTTGGG-3' (SEQ ID NO: 91) | A22 |
| hF8-94323-R | 5'-TGTCCCTGATTCCTCTACCC-3' (SEQ ID NO: 92) | A22 |
| hF8-116050-F | 5'-ATGCAAAATGCTTCTCAGGC-3' (SEQ ID NO: 93) | A23 |
| hF8-116647-R | 5'-AAAAGCTTGTTCAAAATAAATGG-3' (SEQ ID NO: 94) | A23 |
| hF8-117559-F | 5'-TCTGTACCACTTCTTCCAGGG-3' (SEQ ID NO: 95) | A24 |
| hF8-118125-R | 5'-TTTATGCCAGTCCAACCTGC-3' (SEQ ID NO: 96) | A24 |
| hF8-118087-F | 5'-TATTTTTGGAAGGTGGGAGG-3' (SEQ ID NO: 97) | A25 |
| hF8-118699-R | 5'-CGAATCCTTTGATCCTGAGC-3' (SEQ ID NO: 98) | A25 |
| hF8-118318-F | 5'-TTGATGAGACCAAAAGCTGG-3' (SEQ ID NO: 99) | A26 |
| hF8-118933-R | 5'-AGAGCATGGAGCTTGTCTGC-3' (SEQ ID NO: 100) | A26 |

-continued

| Primer Name: | Sequence: | Amplicon: |
|---|---|---|
| hF8-120414-F | 5'-AAGCACTTTGCATTTGAGGG-3' (SEQ ID NO: 101) | A27 |
| hF8-120947-R | 5'-TGGAGATCTTCGAGCTTTACC-3' (SEQ ID NO: 102) | A27 |
| hF8-121066-F | 5'-GGACCCCAGTTTCTTCAGC-3' (SEQ ID NO: 103) | A28 |
| hF8-121510-R | 5'-AGTGGGAAGTGGAGAGGAGG-3' (SEQ ID NO: 104) | A28 |
| hF8-122636-F | 5'-GTATGCCATAAAGCCTTTATG-3' (SEQ ID NO: 105) | A29 |
| hF8-123081-R | 5'-GTTCTAATCCCAGTAGAAGG-3' (SEQ ID NO: 106) | A29 |
| hF8-126315-F | 5'-CCACAGCTTCACACACACAT-3' (SEQ ID NO: 107) | A30 |
| hF8-126829-R | 5'-TCTATGAGCCTTGACACTAC-3' (SEQ ID NO: 108) | A30 |
| hF8-159304-F | 5'-ttcccacttcttcttggtgc-3' (SEQ ID NO: 109) | A32 |
| hF8-159934-R | 5'-tgggcatttaggttgactcc-3' (SEQ ID NO: 110) | A32 |
| hF8-160633-F | 5'-tcatgccactacactccagc-3' (SEQ ID NO: 111) | A33 |
| hF8-161150-R | 5'-ctgcccataaccaaacttcc-3' (SEQ ID NO: 112) | A33 |
| hF8-161982-F | 5'-gggtgacagagcaagactcc-3' (SEQ ID NO: 113) | A34 |
| hF8-162549-R | 5'-aaaaggettgggaatcaagg-3' (SEQ ID NO: 114) | A34 |
| hF8-184818-F | 5'-agatgtcccagatgcgtagg-3' (SEQ ID NO: 115) | A35 |
| hF8-185411-R | 5'-GCTTTCATGCAGGTTTCTCC-3' (SEQ ID NO: 116) | A35 |
| hF8-185329-F | 5'-TATTTTCTGCAGCTGCTCCC-3' (SEQ ID NO: 117) | A36 |
| hF8-185941-R | 5'-CTTTCAACAATTGCATCCTCC-3' (SEQ ID NO: 118) | A36 |
| hF8-185733-F | 5'-GAGGGGCACATTCTTATCTCC-3' (SEQ ID NO: 119) | A37 |
| hF8-186382-R | 5'-TCATAGTGAAGGGGTCAGGC-3' (SEQ ID NO: 120) | A37 |
| hF8-186289-F | 5'-CACCACACAATAGGATCCCC-3' (SEQ ID NO: 121) | A38 |
| hF8-186832-R | 5'-GTCAATGGGAAAAGAATGCC-3' (SEQ ID NO: 122) | A38 |
| hF8-186639-F | 5'-CAATCCACAAATGATGCAGG-3' (SEQ ID NO: 123) | A39 |
| hF8-187259-R | 5'-AGTGCCAGGATTACAGGCAT-3' (SEQ ID NO: 124) | A39 |

F. Examples

The following examples are put forth so as to provide those of ordinary skill in the art with a complete disclosure and description of how the compounds, compositions, articles, devices and/or methods claimed herein are made and evaluated, and are intended to be purely exemplary and are not intended to limit the disclosure. Efforts have been made to ensure accuracy with respect to numbers (e.g., amounts, temperature, etc.), but some errors and deviations should be accounted for. Unless indicated otherwise, parts are parts by weight, temperature is in ° C. or is at ambient temperature, and pressure is at or near atmospheric.

1. Example 1

Recombinant factor VIII (r-fVIII) is the most widely-used and effective therapy for hemophilia A (hA). Many patients unfortunately become refractory when the wildtype (wt) protein is seen as foreign and is targeted by functionally neutralizing anti-fVIII antibodies termed inhibitors. While inhibitors occur most often in severe hemophiliacs with complex fVIII mutations and a complete circulating absence of the fVIII protein, recent studies show patients with missense-mutations (mMt) have a higher incidence than previously thought and demonstrate r-fVIII can be immunologically targeted even when differing by only a single amino acid. Because mMt represent the most frequent overall etiology of hA (~39% of cases), common non-hemophilic protein variants of fVIII may represent an important novel modulator of inhibitor development in this setting. To determine the extent of such variation, all coding regions of the fVIII loci (F8) were resequenced in 137 healthy subjects from 7 ethnic groups, including 86 Caucasians and 16 African-Americans (AA). Five common non-synonymous single nucleotide polymorphisms (nsSNPs) resulting in an amino acid change were identified. Whereas 4 were polymorphic in African-Americans (AA) only 2 were variable in Caucasians, despite having examined 6x the number AA X-chromosomes. Recent studies show AA patients have a 2-fold higher inhibitor incidence than Caucasians, thus establishing ethnicity as a risk factor in this complication. Minor alleles for 2 nsSNPs are restricted to AA and substitute amino acids in major B-cell inhibitor epitopes located in the A2 and C2 domains To confirm these findings and accurately define the number and frequency of human haplotypes (H) (eg. distinct combinations in which the alleles of these 5 nsSNPs are linked in vivo) F8 was resequenced in a second study group that included 75 additional healthy AA. Here there are at least six distinct wt forms of the human NM protein by defining six haplotypes (H) from the four nsSNPs: H1, H2, H3, H4, H5, H6. H1 exists in all ethnic groups, is the most common overall form of fVIII and represents 2 of the 3 r-fVIII concentrates used clinically. While H2 is the most common form in AA (44%) and possibly represents the other therapeutic r-fVIII molecule, at least 20% will have AA-restricted fVIII proteins; H4 (4%) and H5 (12%) Only 2 forms of fVIII were found in Caucasians, H1 (90%) and H2 (10%), in contrast, and neither were ethnically restricted. In summary, when combined with reports of at least 2 other nsSNPs, it is established as inaccurate the long held view that Willis basically a monomorphic protein in non-hemophiliacs. Greater immunologic barriers exist when r-fVIII is infused into patients with mMt in endogenous fVIII molecules containing one or more minor alleles of these nsSNPs. Moreover, due to the number and frequency of AA-restricted wt fVIII variants, these nsSNPs contribute pharmacogenetically to the higher incidence of inhibitors in this ethnic group.

2. Example 2

A high-normal to elevated plasma FVIII activity (FVIII:C) level is associated with increased risk for venous and arterial thrombosis. Despite being a highly heritable trait, the genes, other than the ABO blood group locus, responsible for the broad interindividual variance in FVIII:C remain to be identified. The structural FVIII locus (F8) is reported to have been excluded since earlier studies failed to detect linkage or associations between FVIII:C levels and polymorphisms in or near this candidate gene. However, because these studies were too small to detect quantitative trait loci (QTLs) with modest effects or low frequencies, used genotyping methods less sensitive than sequencing and/or examined only portions of the gene, every known functional region of F8 in 137 unrelated non-hemophilic individuals from different ethnic groups was resequenced. 20 of the 46 single nucleotide polymorphisms (SNPs) identified were previously unknown despite their location in one of the most intensely studied human genes. Because linkage disequilibrium (LD) across F8 was weak overall, the relationship between each SNP and FVIII:C was evaluated in 398 Caucasians from 21 Spanish families—The Genetic Analysis of Idiopathic Thrombophilia Project (GAIT)—using marginal measured genotype association analysis. C92714G, which encodes the conservative B-domain substitution D1241E, was associated with significantly lower FVIII:C levels (each G-allele contributes a 12.8 IU/dL reduction in activity) even after accounting for important covariates, including age and ABO genotype. Nevertheless, studies in other populations and/or in vitro are necessary to determine whether D1241E represents a functional QTL because the alleles of G56010A, a SNP in the 3' splice junction of intron 7, are in strong LD with C92714G.

The (immature) large glycoprotein coagulation factor (F)VIII is synthesized as a single polypeptide chain containing 2351 amino acids. The immature polypeptide sequence for each haplotype is disclosed as follows: H1 (SEQ ID NO: 13), H2 (SEQ ID NO: 14), H3 (SEQ ID NO: 15), H4 (SEQ ID NO: 16), H5 (SEQ ID NO: 17), and H6 (SEQ ID NO: 18). After removal of its 19 amino acid N-terminal signal-peptide in the endoplasmic reticulum, FVIII undergoes limited proteolysis intracellularly prior to secretion. The mature form of FVIII in plasma therefore contains 2332 amino acids and is a heterodimer comprised of a constant size light-chain and a non-covalently linked variable size heavy-chain. The mature polypeptide sequence for each haplotype is disclosed as follows: H1 (SEQ ID NO: 19), H2 (SEQ ID NO: 20), H3 (SEQ ID NO: 21), H4 (SEQ ID NO: 22), H5 (SEQ ID NO: 23), and H6 (SEQ ID NO: 24).Heterodimeric FVIII is an inactive procofactor that circulates in a non-covalent, tightly bound complex with von Willebrand factor (VWF). Thrombin, generated in low concentrations at sites of vascular injury by the extrinsic pathway during coagulation initiation, proteolytically converts FVIII into its active, but labile, heterotrimeric cofactor form (FVIIIa), which is released from VWF. Upon assembly, FVIIIa participates in the propagation phase of coagulation as a cofactor for the catalytically active serine protease FIX (FIXa) within a macromolecular enzyme complex known as intrinsic Xase after binding to membrane surfaces containing anionic phospholipids, whose sole function is to catalyze cleavage activation of its zymogen substrate FX. Hemophilia A, the X-linked bleeding disorder due to insufficient or absent FVIII coagulant activity (FVIII:C) in plasma, demonstrates that FVIII is indispensable for normal hemostasis. However a high-normal to elevated plasma FVIII activity (FVIII:C) level is associated with an increased risk for both venous and arterial thrombosis.

Several environmental and endogenous factors are associated with broad interindividual variability that exists for FVIII:C levels. Age, sex, oral contraception (OC), smoking, body mass index (BMI), diabetes mellitus (DM), ABO blood type, and plasma levels of total cholesterol (TC), low-density lipoprotein (LDL), triglyceride (TG), VWF, and FIX coagulant activity (FIX:C) all have substantial evidence supporting their role as determinants of FVIII:C. The relative ease of identifying, observing, measuring and/or characterizing these factors enabled investigators to discern their relationships with plasma FVIII:C level.

The 186-kilobase (kb) F8 gene, which is located on the long-arm (q) of the X chr within Xq28.1, and consists of 26 exons that comprise only five percent of the base pair (bp) total. Transcription may be robust to genetic variation in the promoter, particularly in the case of SNPs which do not cause length changes that could markedly destabilize the pre-initiation complex whose DNA-binding proteins overlap the transcription start site. The 1200-bp upstream DNA region from −1038 to +236, which contains most of the 5'-UTR, sufficiently promoted transcription in several liver-derived cell lines. Furthermore, 300-bp of the immediately contiguous 5'-genomic DNA exerted maximal promoter activity. This region contains several cis-elements that interact with DNA-binding proteins important for the transcriptional regulation of this gene; including a TATA-like sequence (GATAAA) located 30-bp upstream of the transcription start site. Additional cis-elements may also function as transcriptional regulators including a potential repressor located approximately 1-kilobase (kb) upstream of the gene. The presence of variants in this region of the promoter might contribute to "normal" variation of FVIII levels through variable transcription rates.

The F8 variation scan systematically covered the entire gene using a large number of chromosomes to identify variations in. A scan of F8 regions classically considered functional in 137 people for a total of 222 X-chromosomes was performed. All of the 398 subjects of the GAIT (Genetic Analysis of Idiopathic Thrombophilia) project were genotyped for the subset of variants polymorphic in the sample of Caucasians used.

F8 Reference Sequence

A 286-kb stretch of genomic DNA from Xq28.1 was obtained that contained the 186-kb F8 sequence plus 50-kb of both 5'- and 3'-genomic sequence from the UCSC Genome Browser on Oct. 12, 2004, which corresponds to NCBI Build 35 (hg17, the May 2004 release). This is the first version to contain all 26 exons; specifically, it included exons 21 and 22, which were missing from previous releases. For purposes of referencing the gene and variants, the reverse compliment of this sequence was used and assigned +1 to the transcription start site (+1 GCT-TAGTGCTGAG +13) that and −1 to the base immediately 5' to it. For instance, the promoter contains nucleotides with negative numbers and the putative TATA-box, GATAA, begins with G at base −30. "hg17" was used to indicate that the nucleotide numbering follows this convention.

Variaton Scan

The variation covered all exonic sequences (coding and untranslated), 50- to 100-bp of intronic sequence from each splice junction, approximately 1-kb of the promoter, and about 300-bp of the immediately flanking 3'-genomic DNA. Table 1 lists the exonic regions, their lengths, hg17 nucleotide positions, and the encoded amino acids, if any. DNA fragments were amplified and sequenced that were 500- to 600-bp in length and, where necessary to cover an extended region, overlaped the primers by approximately 100-bp. Initially, 39 amplicons were generated, but lacked coverage of exons 21 and 22. Though absent from the variation scan, amplicons (designated amp29B and amp30B) were included for these two regions in the genotyping described below. Table 2 lists the amplicons and their hg17 nucleotide positions. Agencourt Biosciences performed the polymerase chain reaction (PCR) amplifications, cycle-sequencing reactions, and sequence determinations. The variation scan was performed using genomic DNA samples obtained from two discovery groups of human subjects. The first wave included genomic DNAs from 90 distinct individuals and one additional blind replicate. In addition, female GAIT founders were included (i.e., one unrelated female drawn from each of the GAIT families). The second wave consisted of 47 GAIT founders, 37 females and 10 males, with FVIII:C levels at the extremes of the founders. A total of 222 X-chromosomes were collected and the amplicons were sequenced in the forward and reverse directions in both of these waves.

TABLE 1

Characteristics of the 26 exons in F8.

| Exon | Length (bp) | Nucleotides* | Amino Acids[+] |
|---|---|---|---|
| 01 (5'-UTR) | 171 | 1 . . . 171 | NA |
| 01 (CDS) | 143 | 172 . . . 314 | 1 . . . 29 |
| 02 | 122 | 23124 . . . 23245 | 29 . . . 70 |
| 03 | 123 | 25629 . . . 25751 | 70 . . . 111 |
| 04 | 213 | 29576 . . . 29788 | 111 . . . 182 |
| 05 | 69 | 35419 . . . 35487 | 182 . . . 205 |
| 06 | 117 | 37921 . . . 38037 | 205 . . . 244 |
| 07 | 222 | 53172 . . . 53393 | 244 . . . 318 |
| 08 | 262 | 56037 . . . 56298 | 318 . . . 405 |
| 09 | 172 | 56583 . . . 56754 | 405 . . . 462 |
| 10 | 94 | 61556 . . . 61649 | 463 . . . 494 |
| 11 | 215 | 65553 . . . 65767 | 494 . . . 565 |
| 12 | 151 | 68682 . . . 68832 | 566 . . . 616 |
| 13 | 210 | 74817 . . . 75026 | 616 . . . 686 |
| 14 | 3106 | 91048 . . . 94153 | 686 . . . 1721 |
| 15 | 154 | 116151 . . . 116304 | 1721 . . . 1772 |
| 16 | 213 | 117701 . . . 117913 | 1773 . . . 1843 |
| 17 | 229 | 118200 . . . 118428 | 1844 . . . 1920 |
| 18 | 183 | 118636 . . . 118818 | 1920 . . . 1981 |
| 19 | 117 | 120557 . . . 120673 | 1981 . . . 2020 |
| 20 | 72 | 121282 . . . 121353 | 2020 . . . 2044 |
| 21 | 86 | 122773 . . . 122858 | 2044 . . . 2072 |
| 22 | 156 | 126492 . . . 126647 | 2073 . . . 2124 |
| 23 | 145 | 159497 . . . 159641 | 2125 . . . 2173 |
| 24 | 149 | 160858 . . . 161006 | 2173 . . . 2222 |
| 25 | 177 | 162116 . . . 162292 | 2223 . . . 2281 |
| 26 (CDS) | 153 | 184972 . . . 185124 | 2282 . . . 2332 |
| 26 (3'-UTR) | 1806 | 185125 . . . 186930 | NA |

*Nucleotide numbering corresponds to the hg 17 reference sequence for F8.
[+]Amino acids whose codons are completely or partly contained in each exon; numbering based on the mature protein found in plasma (after removal of the 19 residue signal peptide), whose N-terminal alanine (amino acid # 1) corresponds to the 20th-translated residue; NA—not applicable.

Genotyping

TABLE 2

F8 regions sequenced to identify and genotype common polymorphisms.

| Amplicon | Forward Primer | SEQ ID NO. | Reverse Primer | SEQ ID NO. | Nucleotides |
|---|---|---|---|---|---|
| 01 | 5'-TTATCAPAGCGGCTTCTTGC | 49 | 5'-CATGCCCTTTCTCCTGACC | 50 | −1214 . . . −573 |
| 02 | 5'-AGCAAGTGTTGAGGTCCAGG | 51 | 5'-TGAAGTAGCAAAAGGGAGGC | 52 | −683 . . . −56 |
| 03 | 5'-CTTCTCCATCCCTCTCCTCG | 135 | 5'-CAGAAATGTTTCTTTGGGGC | 54 | −168 . . . 441 |
| 04 | 5'-CTTCAAATTTGCCTCCTTGC | 55 | 5'-AGACCAAGCAGAGGAAGACG | 56 | 23012 . . . 23436 |
| 05 | 5'-AATCTTGCCTCAGAGCAACC | 57 | 5'-GAAAAGCAATTCCTAGGGGG | 58 | 25450 . . . 26066 |
| 06 | 5'-GGGCAACAGAGTGAGACTCC | 59 | 5'-TTCTGGAACTCAGCTCCTCC | 60 | 29413 . . . 30016 |
| 07 | 5'-GGAGACCTGACATCAAAGCC | 61 | 5'-AACCCCATCTCCTTCATTCC | 62 | 35266 . . . 35608 |
| 08 | 5'-TAAGGTGTGAGCACACTGGG | 63 | 5'-CGATGAGTTCTGTTCTGAGCC | 64 | 37821 . . . 38404 |
| 09 | 5'-ATGGTGATTGGTGACCTTGG | 65 | 5'-GGAAACTAGGGGATCTTGGC | 66 | 52986 . . . 53544 |

TABLE 2 -continued

F8 regions sequenced to identify and genotype common polymorphisms.

| Amplicon | Forward Primer | SEQ ID NO. | Reverse Primer | SEQ ID NO. | Nucleotides |
|---|---|---|---|---|---|
| 10 | 5'-GTCTTGCTCCTGCTTTCACC | 67 | 5'-TACCCTTGCCATTTGATTCC | 68 | 55802 . . . 56428 |
| 11 | 5'-CTGCTGAAGAGGAGGACTGG | 69 | 5'-ATGTCCATTGGAGACAAGGC | 70 | 56244 . . . 56855 |
| 12 | 5'-GATTGTGGTATCTGCAGGGG | 71 | 5'-CAACAGCTGGAGAAAGGACC | 72 | 61345 . . . 61753 |
| 13 | 5'-TGACACTTTCACAGTCAACCG | 73 | 5'-CAGCAGGCACGTTTACTACG | 74 | 65333 . . . 65920 |
| 14 | 5'-CAGTCACCCTCTTGTCCTGG | 75 | 5'-GGGAATTAAAAGGGAGAGGG | 76 | 68456 . . . 69067 |
| 15 | 5'-CCTGGGAATAAGATAATGGGC | 77 | 5'-AAATGCTGGTGAGGATGTGG | 78 | 74699 . . . 75338 |
| 16 | 5'-ACAGCAGCAATGCAAAAACC | 79 | 5'-TCTATTGCTCCAGGTGATGG | 80 | 90867 . . . 91468 |
| 17 | 5'-ATGCTCTTGCGACAGAGTCC | 81 | 5'-AACAAAGCAGGTCCATGAGC | 82 | 91365 . . . 91942 |
| 18 | 5'-TTGGCAAAAGTCATCTCCC | 83 | 5'-CTAATTGCTTTGGACTGGGG | 136 | 91756 . . . 92379 |
| 19 | 5'-CCACCAGATGCACAAAATCC | 85 | 5'-TTTGCTTGGTTTGATTTCCC | 86 | 92247 . . . 92850 |
| 20 | 5'-GAAGGTTCATATGAGGGGGC | 87 | 5'-ATGACTGCTTTCTTGGACCC | 137 | 92700 . . . 93290 |
| 21 | 5'-TCTGACCAGGGTCCTATTCC | 89 | 5'-CATGATTGCTTTCACAAGCG | 90 | 93200 . . . 93816 |
| 22 | 5'-ATTGGATCCTCTTGCTTGGG | 91 | 5'-TGTCCCTGATTCGTCTACCC | 92 | 93674 . . . 94323 |
| 23 | 5'-ATGCAAAATGCTTCTCAGGC | 93 | 5'-AAAAGCTTGTTCAAAATAAATGG | 94 | 116050 . . . 116647 |
| 24 | 5'-TCTGTACCACTTCTTCCAGGG | 95 | 5'-TTTATGCCAGTCCAACCTGC | 96 | 117559 . . . 118125 |
| 25 | 5'-TATTTTTGGAAGGTGGGAGG | 97 | 5'-CGAATCCTTTGATCCTGAGG | 138 | 118087 . . . 118699 |
| 26 | 5'-TTGATGAGACCAAAAGCTGG | 99 | 5'-AGAGCATGGAGCTTGTCTGC | 100 | 118318 . . . 118933 |
| 27 | 5'-AAGCACTTTGCATTTGAGGG | 101 | 5'-TGGAGATCTTCGAGCTTTACC | 102 | 120414 . . . 120947 |
| 28 | 5'-GGACCCCAGTTTCTTCAGC | 103 | 5'-AGTGGGPAGTGGAGAGGAGG | 104 | 121066 . . . 121510 |
| 29B | 5'-GAATTTAATCTCTGATTTCTC-TAC | 125 | 5'-GAGTGAATGTGATACATTTCCC | 126 | 122740 . . . 122902 |
| 30B | 5'-TAAAAATAGGTTAAAATAAAGTG | 127 | 5'-TTTAAATGACTAATTACATACCA | 128 | 126453 . . . 126668 |
| 29A | 5'-TCAGGGTTGGTTACTGGAGC | 129 | 5'-ACACTACCATGGTCTTGGGG | 130 | 158245 . . . 158735 |
| 30A | 5'-AGTCAGTGGGCCTGTTATGG | 131 | 5'-GTCCCTAGCTCTTGTTCCCC | 132 | 158526 . . . 159105 |
| 31 | 5'-TGGGCAGATAGGGATAGTGG | 133 | 5'-TTTGTGCGTTTCTCAACAGG | 134 | 158833 . . . 159409 |
| 32 | 5'-TTCCCACTTCTTCTTGGTGC | 109 | 5'-TGGGCATTTAGG1TGACTCC | 110 | 159304 . . . 159934 |
| 33 | 5'-TCATGCCACTACACTCCAGC | 111 | 5'-CTGCCCATAACCAAACTTCC | 112 | 160633 . . . 161150 |
| 34 | 5'-GGGTGACAGAGCAAGACTCC | 113 | 5'-AAAAGGCTTGGGAATCAAGG | 114 | 161982 . . . 162549 |
| 35 | 5'-AGATGTCCCAGATGCGTAGG | 115 | 5'-GCTTTCATGCAGGTTTCTCC | 116 | 184818 . . . 185411 |
| 36 | 5'-TATTTCTGCAGCTGCTCCC | 117 | 5'-CTTTCAACAATTGCATCCTCC | 118 | 185329 . . . 185941 |
| 37 | 5'-GAGGGGCACATTCTTATCTCC | 119 | 5'-TCATAGTGAAGGGGTCAGGC | 120 | 185733 . . . 186382 |
| 38 | 5'-CACCACACAATAGGATCCCC | 121 | 5'-GTCAATGGGAAAAGAATGCC | 122 | 186289 . . . 186832 |
| 39 | 5'-CAATCCACAAATGATGCAGG | 123 | 5'-AGTGCCAGGATTACAGGCAT | 124 | 186639 . . . 187259 |

* To include all known functional F8 regions in the variation scan 41 distinct segments (i.e., amplicons) of this structural locus were PCR amplified from genomic DNA samples and resequenced directly To genotype the 12 F8 variations that were polymoiphic in Caucasians (Table 3) in the entire GAIT cohort the 11 amplicons in bold were generated by the PCR and re sequenced directly.
* Nucleotide numbers correspond to the hg17 reference sequence for F8.

Chromatograms were used to both detect and genotype variants at all stages. Agencourt used the PHRAP suite (phrap.org) to identify variants. PHRED output was used and a custom written SAS 8.2 program was used to genotype individuals at the variant bases reported by Agencourt. In addition, the SAS program generated a separate chromatogram for each variant that placed the base of interest between two 10-bp flanks. By being compact and centering on the variant, these chromatograms standardized the manual review of the calls, when necessary. In the remaining GAIT individuals not in the variation scan, Agencourt sequenced the subset of amplicons in which at least one variable nucleotide was found among the Caucasians in the forward direction only. Finally, to verify the accuracy of the genotyping, as measured by the ability to confirm the original genotyping call, a subset of samples was replicated. When necessary to resolve any missing genotypes, amplicons were generated and sequenced. When it was necessary to perform manual reviews, forward and reverse sequences were paired from the same individuals, but the file names were not un-blinded, which revealed the well address and amplicon. INFER (PEDSYS, San Antonio, Tex.) was used to search for violations of Mendelian inheritance within the GAIT project, blanking any resulting discrepancies.

Statistical Analyses

The program Genecounting was used to estimate $r^2$ and D', measures of allelic association. The program SOLAR was used to create plots of these statistics.

The measured genotype approach was employed to determine whether, among the members of the GAIT project, there were marginal genotype-specific differences in the mean FVIII:C level, adjusted for relevant environmental and endogenous factors. To account for the non-independence among family members, the analyses was performed using the program SOLAR, a likelihood-based variance component genetic analysis program. Any FVIII:C value was set beyond four standard deviations from the mean to missing.

Data was had for the following covariates: age, sex, smoking status, OC use, ABO blood group genotype, total cholesterol (TC), high density lipoprotein (HDL), low density lipoprotein (LDL), very low density lipoprotein (VLDL), triglycerides (TG), lipoprotein(a), BMI, diabetes mellitus (DM) status, VWF:Ag, and F1X:C. ABO genotypes were represented with indicator variables. For instance, AO had a value of one if the patient's genotype was AO, and it had a value of zero otherwise. A zero in each of the variables (AA, AB, AO, and BO) indicated the OO genotype, the reference level. Both smoking status and OC use were represented with dichotomous variables that indicated any versus no use, the reference level. Simple analyses were performed for each of the above variables to evaluate the association with FVIII:C levels. In these first analyses the covariate was the sole independent variable except in the case of ABO, which consisted of indicator variables, and age, which also had higher order terms. Further, bivariate analyses were performed with the endogenous factors and FVIII:C levels to investigate a shared genetic source. Those factors were excluded that shared common underlying genetic influences with FVIII:C from the final measured genotype analysis.

Because SNPs, including single-base-substitutions (SBSs) and insertion/deletions (INDELs), have a major (M) and minor (m) allele, there are five possible genotypes for each. Specifically, there are three genotypes in females who have two X-chromosomes (homozygous M-allele $[X_M|X_M]$, heterozygous $[X_M|X_m]$ and homozygous m-allele $[X_m|X_m]$), and two in males who receive their mother's X-chromosome and father's Y-chromosome (hemizygous M-allele $[X_M|Y]$ and hemizygous m-allele $[X_m|Y]$). Thus, the genotype of each SNP was represented with a value of either 1 ($[X_M|X_M]$ and $[X_M|Y]$), 0($[X_M|X_m]$), or −1 ($[X_m|X_m]$ and $[X_m|Y]$), respectively, since no a priori knowledge was had of which allele might be associated with increased FVIII:C levels. Initial complex analyses were performed separately for each SNP in which age, $age^2$, sex, age×sex, $age^2$×sex, AA, AB, AO, BO, smoking status and OC use were covariates to test for differences in the marginal genotype-specific mean FVIII:C levels. Subsequently analyses were performed using all of the available covariates previously mentioned for any SNP suggestively associated with FVIII:C levels at the p=0.10 level. The reason behind this tactic was to not enforce the same mechanistic effect on every SNP, but to allow for potential individual actions. In addition, age was represented by employing linear splines with knots at 15 and 50 years. A logarithmic transformation of FVIII:C levels was used to improve normality and a constant multiplier of 8.2 to avoid potential precision problems with numeric iteration in the statistical routines.

FVIII:C Levels

Figure 7:
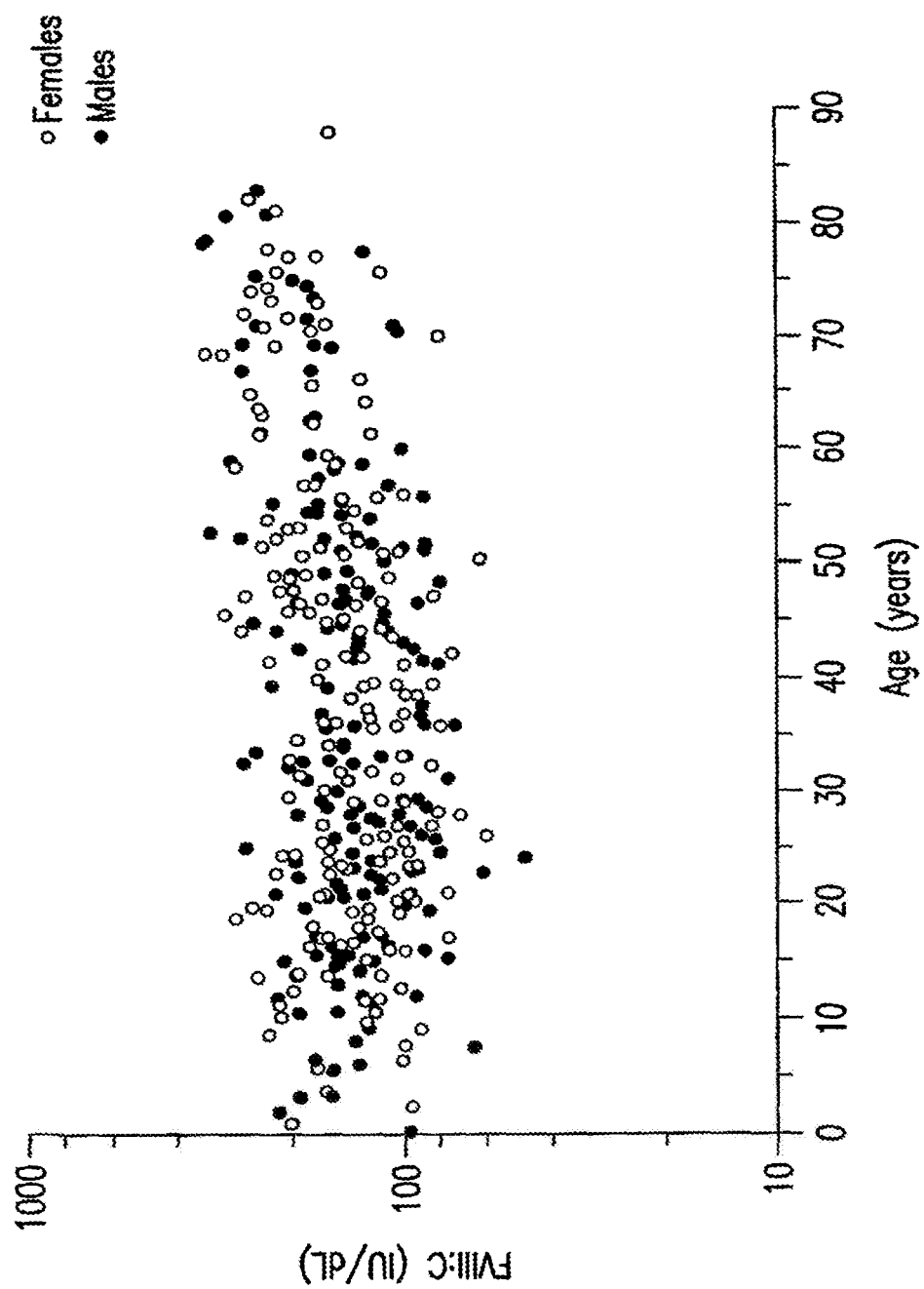
FIG. 7 presents the FVIII:C levels versus age indicating the sex of each subject.

The mean±standard deviation (SD) for the FVIII:C levels in the GAIT study subjects was 150.7 IU/dL (±52.2 IU/dL), after excluding two women whose FVIII:C levels were more than 4 SD from the mean. FIG. 7 presents the FVIII:C levels versus age indicating the sex of each subject.

Variation Scan 46 distinct SNPs were identified, which included 45 SBS and one INDEL, among the 19,157-bp covered in the variation scan. Table 3 lists these variants, their protein and genic details, and whether the UW-FHCRC scan or dbSNP also reported them. In this table, bold print indicates the variants genotyped in the GAIT subjects and the italics indicate nonsynonymous SNPs.

TABLE 3

| Gene (region) | F8 Polymorphisms | | Minor Allele Frequencies* | | | | | | | | F8 Variation Databases [a] | | |
|---|---|---|---|---|---|---|---|---|---|---|---|---|---|
| | Nucleotide (position/ allele) | Amino Acid (position/ allele) | Total | C (n = NP) | AA (n = 26) | Ch (n = 13) | SEA (n = 15) | J (n = 8) | MI (n = 8) | SAA (n = 8) | HAMD (HAM-STeRS) | UW-FHCRC (VDR) | NCBI (dbSNP) |
| Promote | G-000825A | | 0.9% | NP | 7.7% | NP | NP | NP | NP | NP | NF | F8-002289 | NF |
| Promote | G-000824A | | 0.9% | NP | 7.7% | NP | NP | NP | NP | NP | NF | F8-002290 | NF |
| Promote | G-000493A | | 0.5% | NP | 3.8% | NP | NP | NP | NP | NP | NF | F8-002621 | rs4898404 |
| Promote | 4A:- | | 0.9% | NP | NP | NP | NP | NP | 25.0% | NP | NF | NF | NF |
| Promote | T-000287C | | 0.5% | NP | 3.8% | NP | NP | NP | NP | NP | + | NF | NF |
| Intron 02 | G025610A | | 0.5% | NP | 4.5% | NP | NP | NP | NP | NP | + | F8-028722 | NF |
| Intron 03 | G025865A | | 0.5% | NP | 4.2% | NP | NP | NP | NP | NP | NF | F8-028977 | NF |
| Intron 03 | G025885C | | 0.5% | NP | 4.2% | NP | NP | NP | NP | NP | NF | F8-028997 | NF |
| Intron 03 | C029567T | | 0.5% | NP | NP | NP | NP | NP | NP | 12.5% | NF | NF | NF |
| Intron 04 | T029854C | | 0.5% | NP | 3.8% | NP | NP | NP | NP | NP | NF | NF | NF |
| Intron 05 | C035518G | | 0.9% | NP | 8.0% | NP | NP | NP | NP | NP | NF | NF | NF |

TABLE 3-continued

| Gene (region) | Nucleotide (position/ allele) | Amino Acid (position/ allele) | Total | C (n = NP) | AA (n = 26) | Ch (n = 13) | SEA (n = 15) | J (n = 8) | MI (n = 8) | SAA (n = 8) | HAMD (HAM-STeRS) | UW-FHCRC (VDR) | NCBI (dbSNP) |
|---|---|---|---|---|---|---|---|---|---|---|---|---|---|
| Intron 06 | A053034G | | 0.5% | 0.7% | NP | NP | NP | NP | 1 NP | NP | NF | NF | NF |
| V. Ex | G053206T | VI. W0255C | 0.5% | NP | NP | NP | 6.7% | NP | NP | NP | +* | NF | NF |
| Intron 07 | C055938A | | 0.5% | NP | NP | NP | 6.7% | NP | NP | NP | NF | NF | NF |
| Intron 07 | G056010A | | 9.6% | 6.4% | 26.9% | 7.7% | NP | 12.5% | 12.5% | 25.0% | + | F8-059122 | rs7058826 |
| Exon 08 | G056113A | A0343A | 0.5% | NP | 3.8% | NP | NP | NP | NP | NP | + | F8-059225 | rs1800289 |
| Intron 09 | T061534C | | 0.5% | NP | 3.8% | NP | NP | NP | NP | NP | NF | F8-064646 | rs5986899 |
| Exon 10 | G061620A | H0484R | 0.9% | NP | 8.3% | NP | NP | NP | NP | NP | + | NF | NF |
| Intron 13 | A090948G | | 0.5% | NP | NP | NP | NP | NP | NP | 12.5% | NF | NF | NF |
| Exon 14 | A091317G | R0776G | 0.5% | NP | NP | 7.7% | NP | NP | NP | NP | NF | NF | rs2228152 |
| Exon 14 | C092555T | H1188H | 0.5% | NP | 4.3% | NP | NP | NP | NP | NP | + | F8-095667 | NF |
| | C092714G | D1241E | 14.7% | 7.7% | 72.7% | 7.7% | NP | 12.5% | 12.5% | 25.0% | + | F8-095826 | rs1800291 |
| | A092798C | S1269S | 7.7% | 6.3% | 3.8% | 7.7% | 20.0% | NP | 12.5% | 25.0% | + | F8-095910 | rs1800292 |
| Exon 14 | G092927A | K1312K | 0.5% | NP | NP | NP | 6.7% | NP | NP | NP | NF | NF | NF |
| Exon 14 | C093401G | V1470V | 0.5% | NP | 4.5% | NP | NP | NP | NP | NP | NF | NF | NF |
| Exon 14 | G093434A | P1481P | 0.9% | NP | 9.1% | NP | NP | NP | NP | NP | + | NF | NF |
| Intron 15 | C116434T | | 0.5% | NP | NP | 7.7% | NP | NP | NP | NP | NF | NF | NF |
| Intron 18 | T118909A | | 20.3% | 14.6% | 84.6% | 7.7% | 14.3% | NP | 42.9% | 37.5% | + | F8-122021 | rs4898352 |
| Intron 19 | T120776C | | 24.5% | 17.3% | 75.0% | 7.7% | 18.7% | NP | 37.5% | 50.0% | + | F8-123888 | rs4074307 |
| Intron 22 | C158352T | | 0.5% | 0.7% | NP | NP | NP | NP | NP | NP | NF | NF | NF |
| Intron 22 | T158368C | | 0.5% | 0.7% | NP | NP | NP | NP | NP | NP | NF | F8-161500 | NF |
| Intron 22 | C158635T | | 0.5% | NP | 3.8% | NP | NP | NP | NP | NP | + | F8-161767 | rs5987054 |
| Intron 22 | A156777G | | 0.5% | 0.7% | NP | NP | NP | NP | NP | NP | NF | NF | NF |
| Intron 22 | C158820T | | 0.5% | NP | 3.8% | NP | NP | NP | NP | NP | + | F8-161952 | rs5987053 |
| Intron 22 | G159087A | | 0.5% | 0.7% | NP | NP | NP | NP | NP | NP | NF | NF | NF |
| Intron 23 | | | 1.4% | 1.4% | 3.8% | NP | NP | NP | NP | NP | NF | F8-163006 | NF |
| Intron 24 | G162013T | | 3.3% | 5.0% | NP | NP | NP | NP | NP | NP | + | F8-165145 | NF |
| Exon 25 | A162161G | M2238V | 1.8% | NP | 15.4% | NP | NP | NP | NP | NP | NF | F8-165293 | rs1705196 |
| Intron 25 | T162475C | | 4.1% | 5.6% | NP | NP | NP | NP | NP | 12.5% | + | F8-165607 | NF |
| 3'-UTR[†] | C185156T | | 0.6% | NP | 3.8% | NP | NP | NP | NP | NP | NF | F8-188288 | rs5986887 |
| 3'-UTR[†] | G186341A | | 0.5% | NP | NP | NP | NP | 12.5% | NP | NP | NF | NF | NF |
| 3'-UTR[†] | A186506G | | 0.5% | 0.7% | NP | NP | NP | NP | NP | NP | NF | NF | NF |
| 3'-UTR[†] | | | 0.5% | 0.7% | NP | NP | NP | NP | NP | NP | NF | NF | NF |
| 3'-UTR[†] | A186799G | | 24.8% | 17.4% | 76.9% | NP | 13.3% | NP | 50.0% | 50.0% | + | F8-189931 | rs1050705 |
| 3'-gDNA[†] | T186987G | | 0.9% | NP | 9.1% | NP | NP | NP | NP | NP | NF | F8-190119 | NF |
| 3'-gDNA[†] | T187064C | | 1.8% | NP | 15.4% | NP | NP | NP | NP | NP | NF | F8-190196 | NF |

*Frequencies estimated in 137 unrelated subjects from different ethnic groups: Caucasians (C), both Caucasian-American and Spanish-Caucasian; African-American (AA); Chinese (Ch); Japanese (J); Southeast Asian, excluding Ch and J (SEA); Mexican Indian (MI); and South American Andes (SAA).
Genotype data were not complete for all subjects and variants, resulting in denominators that varied from the maximum number of X chromosomes for a group. Underlined SNPs were the ones genotyped in the entire GAIT cohort. [†]The bolded coding region SNPs emphasize the non-synonymous subset.
[a] Databases with F8 polymorphisms: HAMD—the HAMSTeRS Hemophilia-A Mutation Database (+ indicates a previously known polymorphism; *denotes missense mutation causing mild HA); VDR—the Variation Discovery Resource (denotes variants by gene and nucleotide position; located at University of Washington-Fred Hutchinson Cancer Research Center [UW-FHCRC]); dbSNP—database for Single Nucleotide Polymorphisms (denotes variant with a unique identifier; located at the NCBI). NF—not found.

Most of the variants had very low minor allele frequencies (MAF) and, it follows, were present in only one of the racial groups. For instance, 21 SNPs were present only in the group of subjects designated as African American. Of these, only two, A162161G and T187064C, had MAF above 10%. Only eight SNPs were present in more than one group, two of which were present in only two groups (Table 4). For these six alleles, the MAF had great range within the groups such that the description minor allele is a misnomer. For example, the minor allele at nucleotide C92714G in Caucasians was G (7.7%), but with an estimated frequency of 72.7% in African Americans, it is the major allele in this ethnic group.

TABLE 4

| Covariate | Beta Estimate | p-Value |
|---|---|---|
| Age (years) | −0.132 | 0.0167 |
| Sex | 0.253 | 0.0209 |
| Age × Sex | $9.377 \times 10^{-04}$ | 0.9914 |
| A_15* | 0.126 | 0.0289 |
| A_15 × Sex | 0.015 | 0.8693 |
| A_50* | 0.074 | <0.0001 |
| A_50 × Sex | −0.061 | 0.0066 |
| Oral Contraceptive Use (Yes/No) | −0.632 | 0.0271 |

TABLE 4-continued

| Covariate | Beta Estimate | p-Value |
|---|---|---|
| Smoking Status (Yes/No) | −0.288 | 0.0121 |
| AA | 0.882 | <0.0001 |
| AO | 0.648 | <0.0001 |
| AB | 0.727 | 0.0553 |
| BO | 0.668 | 0.0019 |
| BMI (kg/m²) | 0.132 | 0.3439 |
| Triglyceride (mM) | 0.362 | 0.0084 |
| D1241E (+1, 0, −1) | 0.312 | 0.0244 |

*Coefficient for the splines with knots at 15 and 50 years.

Allelic-Association

Figures 8, 8A:
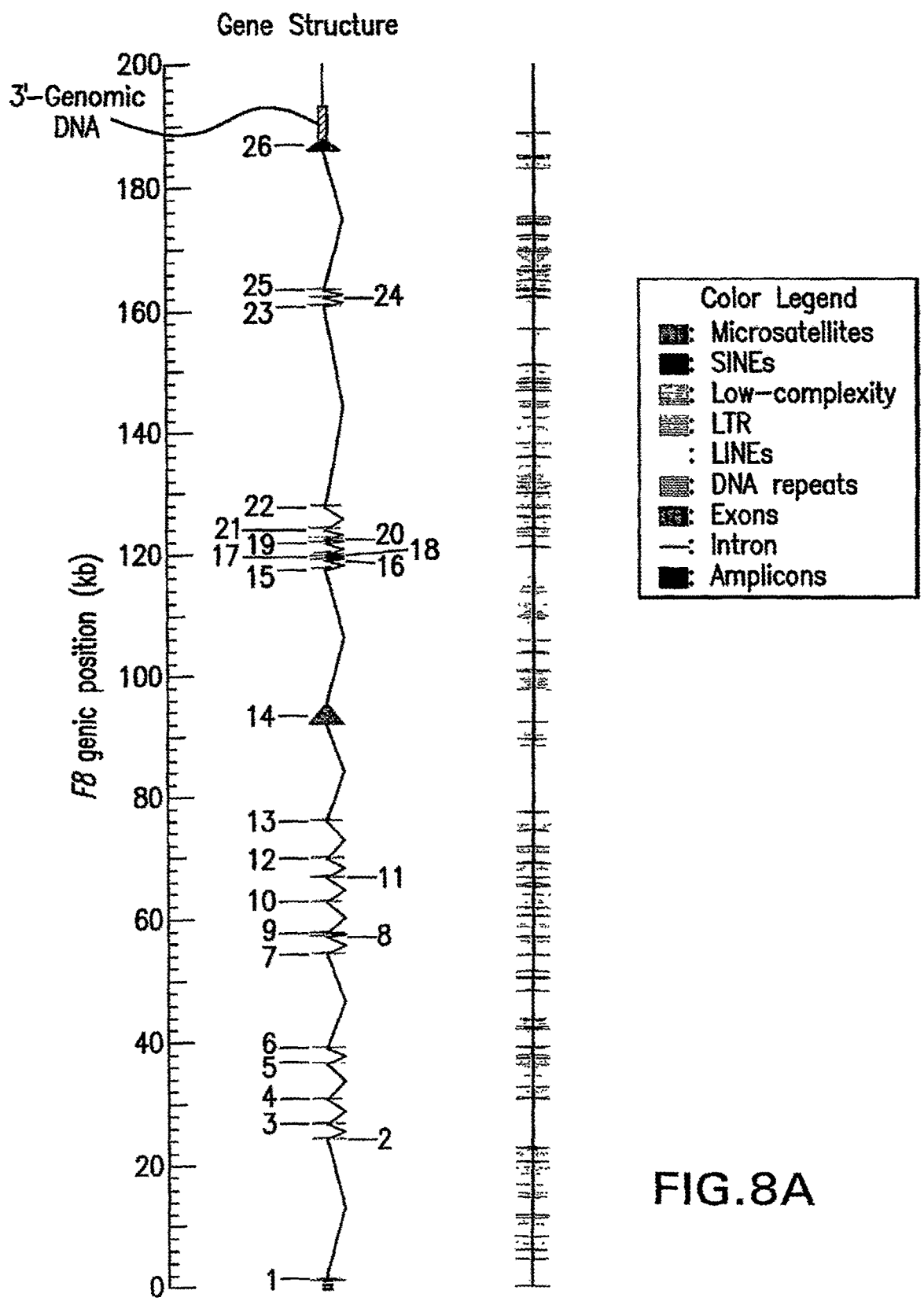
FIG. 8.
FIGS. 8A-8C present the estimated $r^2$ and D' between each pair of alleles, respectively.
Figures 8, 8B, 8C:
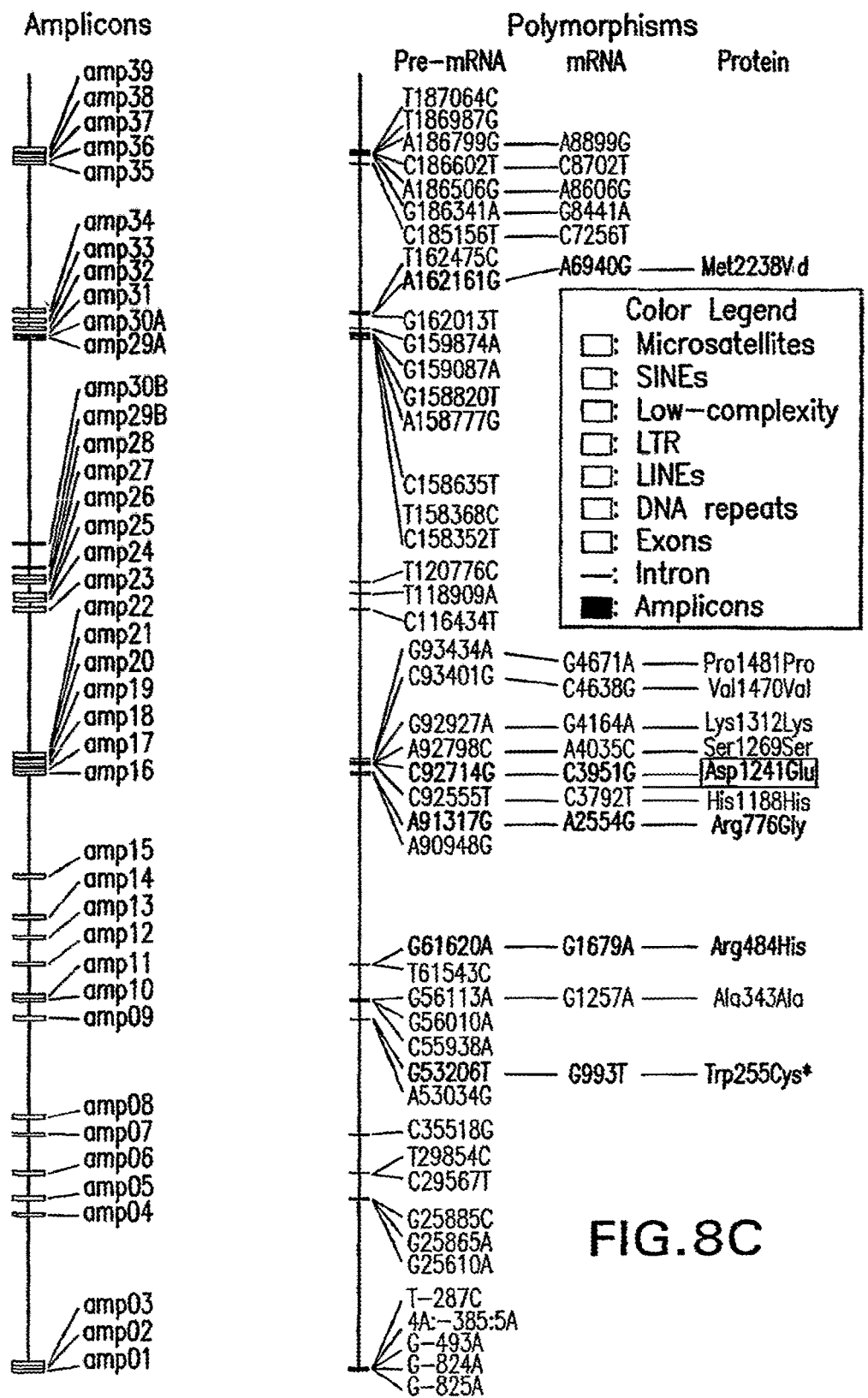

FIG. 8 presents the estimated $r^2$ and D' between each pair of alleles, respectively. (FIG. 8A) The hg17 sequence used as a reference for F8 in this study spans about 287-kb and contains the approximately 187-kb structural locus and 50-kb of both the 5' and 3' flanking genomic DNA. The F8 locus consists of 26 exons (triangles) and 25 introns (intervening black lines). The 1.2-kb and 0.3-kb promoter and flanking 3'-genomic segments scanned for variations are indicated. The numerous repetitive elements (RepeatMasker) in this gene are indicated by different colored triangles. (FIG. 8B) The 41 amplicons used for variation detection and genotyping are indicated by open boxes. (FIG. 8C) The 46

SNPs identified in the variation scan, and two additional SNPs (G75215A and T186594C) discovered by genotyping the extended GAIT cohort for the polymorphismsubset variable in at least Caucasians, are designated by their gene location (left) and nucleotide position in the transcription unit. Promoter SNPs are located upstream of −1. Major- and minor-alleles are shown on the left and right. The 17 exonic- and 11 coding-region-SNPs are also indicated by their nucleotide and amino acid positions in the polyadenylated mRNA and mature form of the circulating FVIII protein, respectively. Finally, the five coding region SNPs resulting in nonsynonymous amino acid substitutions are shown in green; G53206T is actually a missense mutation identified in a non-affected female carrier since Trp255Cys represents a known cause of mild hemophilia A in Chinese individuals.

Measured-Genotype Analysis

Age, smoking status, OC use, DM status, BMI and the plasma levels of TC, LDL, VLDL, TG, VWF and FIX:C were associated with FVIII:C levels at the p=0.10 level. In addition, sex and its interactions with age were included, despite non-significant results in the univariate analysis. Bivariate analyses of FVIII:C levels with both FIX:C and VWF levels suggested that they shared common underlying genetic influences and thus were excluded from the multiple covariate measured-genotype analysis.

Only the analyses for G56010A, an intron 7 SNP located 27 nucleotides upstream of its 3'-splice junction (i.e., position −27), and the non-synonymous coding region SNP C92714G, which encodes the known aspartate to glutamate substitution in the B-domain residue 1241, suggested significant differences in the genotype-specific mean FVIII:C levels. Therefore, these SNPs were further explored separately in a more complex model. Table 4 presents the results of the final model in the analysis of D1241E and FVIII:C levels. Among the GAIT founders who had no parental data, the D' between these two SNPs was 0.84. Since the results were similar, more complete genotyping data was had for D1241E (one DD female, 2 DE females, and 3 EY males had missing genotypes for G56010A), and D1241E results in an amino acid change, the results for this SNP were presented.

When LDL and DM status were included in the full model, the beta-estimate for the effect of D1241E was 0.295 (p=0.0356). Excluding these variables did not meaningfully affect the point estimate or improve the precision (Table 4), suggesting that these factors were not confounding the relationship between this SNP and FVIII:C levels. When VLDL was substituted for TG levels in the above model, the resulting estimate of the effect of D1241E was 0.300 (p=0.0294). As expected, Pearson's correlation coefficient between TG levels and VLDL was high, p=0.96 (p <0.0001), which did not account for non-independence between these observations. The estimate of the correlation coefficient was similar when the analysis was restricted to (independent) founders.

In the completed a variation scan of the known functional regions of the F8 using 222 X-chr from unrelated, non-hemophilic patients two variants were found whose alleles were highly associated with each other, G56010A and C92714G (corresponding to amino acid D1241E), and also significantly associated with FVIII:C levels. Interestingly, there was not strong association between the alleles (see FIG. 9) of F8 variants overall. As far as C92714G is concerned, only four polymorphisms had alleles with a D' of approximately 0.50: G56010A, A118909T, C120776T, and A186799G. Among the GAIT members that had no parental data (i.e., founders), the D' between these alleles and C92714G were 0.84, 0.46, 0.47, and 0.54, respectively.

Figure 9:
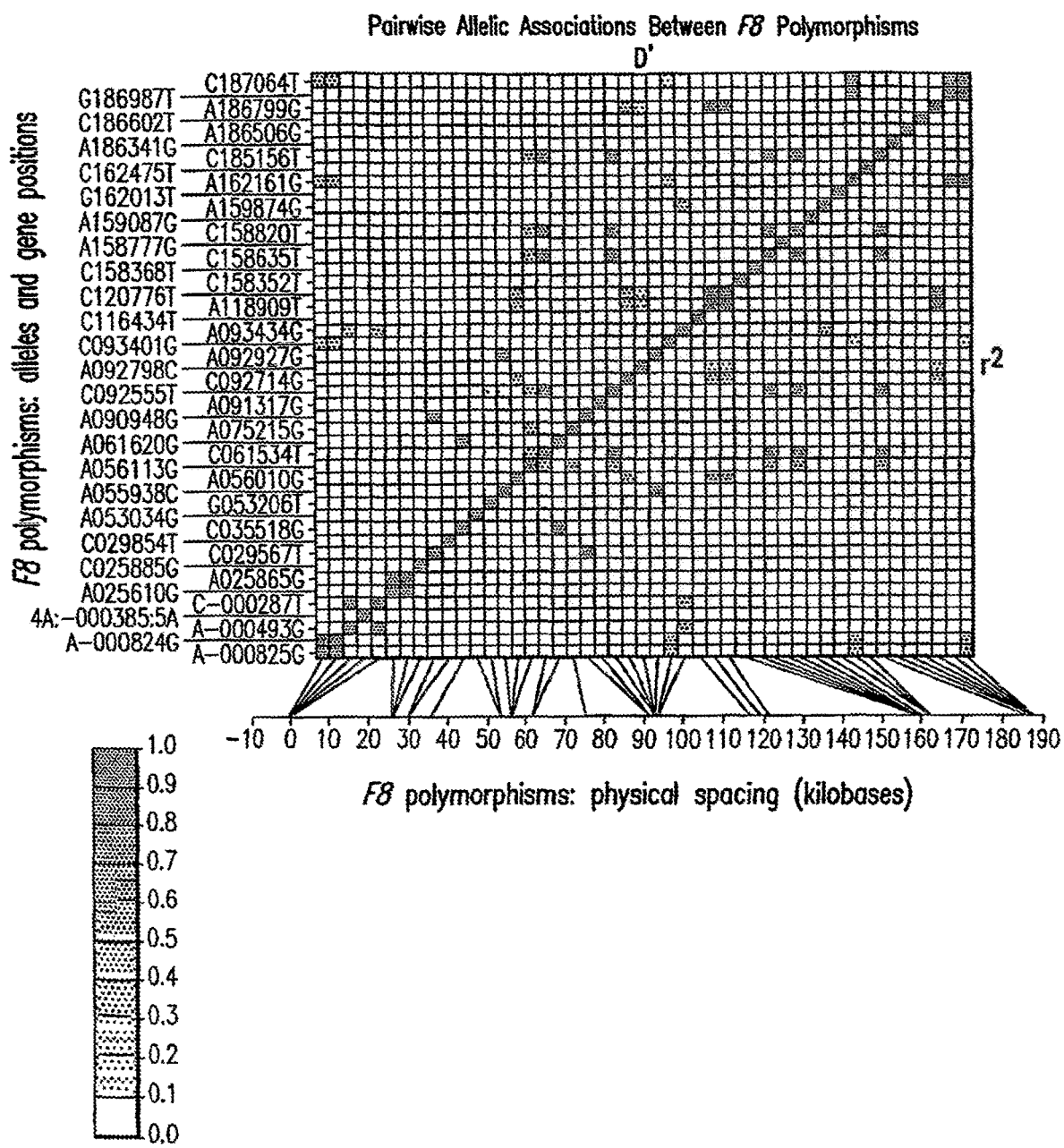
FIG. 9 illustrates the pattern and degree of LD across F8 in various human populations.

FIG. 9 illustrates the pattern and degree of LD across F8 in various human populations. The subset of 47 F8 polymorphisms variable in the 148 unrelated Caucasian subjects studied were evaluated pairwise for LD. Both commonly used parameters of LD (i.e., D' and $r^2$) were determined using maximum likelihood haplotype frequencies estimated by the expectation-maximization (EM) method implemented in GENECOUNTING. Individual polymorphisms are listed along the y-axis in their 5' to 3' gene orientation and along the x-axis according to their nucleotide position within the F8 genomic sequence. The estimates of LD based on D' are shown above the pair-wise line of identity, which passes through the origin, while those based on $r^2$ are shown below. The color legend on right illustrates semi-quantitatively the possible degrees of LD that can exist between the alleles of any polymorphism pair; white (LD=0) indicates linkage equilibrium while red (LD=1) indicates complete LD or allelic association.

The distribution of FVIII:C levels, even within members of the 21 Spanish families of the GAIT project, displayed the typical variability of this trait and had an estimated heritability 0.40. Several factors were controlled for in the final analysis. The support for the association between age and FVIII:C levels is among the strongest. The graph of crude FVDIC levels versus age appears and the results of the analysis also supports this relationship (see FIG. 7 and Table 4, respectively). The use of splines with age allowed for a less rigorous imposition on the data, namely that the same fit not be enforced across the entire range of approximately 2 to 87 years. For example, flexibility was allowed in the effects of age on FVIII:C levels in the young and the old, instead of modeling, for instance, a quadrant effect across both periods in which the age data for the old influences the estimated response for the young, and vice versa.

The results of the analysis support the finding that smokers had lower mean FVIII:C levels than non-smokers. As detailed information on smoking was lacking, this relationship was not further elucidated in the analyses.

OC use had an apparently large effect, to that for ABO blood group (see Table 4).

There is also strong support for an association between FVIII:C levels and ABO blood group and between FVIII:C levels and VWF. In separate bivariate analyses with FVIII:C levels, it was found that each of VWF and FIX had potential overlap in the set of (unknown) genes that may affect their trait levels. Since variance components-based analyses were performed as implemented in the program SOLAR, in which the covariance between family members is used to estimate the additive genetic variance, including such variables in the analyses was not germane to this example. Further, the inclusion ABO blood type, which has a potential pleiotropic effect on VWF and FVIII:C levels, also supports the exclusion of VWF.

Removal of TC/LDL from the model had negligible impact upon the point estimate of the effect of the SNP and its precision. Removal of TG/VLDL had a noticeable impact and VLDL was included. The choice between TG and VLDL was arbitrary and the results were very similar.

SEQUENCE LISTING (138 sequences)

SEQ ID NO: 1 - DNA, 188930 bp, Artificial Sequence
  synthetic construct
tcaccatggctacattctgatgtaaagagatatatcctatacctgggccaaatgtaaacagcctggaaaagtgttaggttaaaaacaaaacaaaataaataaatgaataaatgccaggtggttatgagtgctattgagaaaaatgaagccaagagggatatcagtgatgcaggtgggggtaaagagcttacaacataaatgtggtgttccatatttaaacctcattcaacagggaagattggagctgaaatgtgaaggagttgtgggagtggaactacgtggaaatctgggggaaaggtgttttgggtaaaagaaatagcaagtgttgaggtccaggggcatgagtgtgcttgatattttagggaagagtaaggagaccagtataaccagagtgagatgagactacagaggtcaggagaaagggcatgcagaccatgtgggatgctctaggacctaggccatggtaaagatgtagggttttaccctgatggaggtcagaagccattggaggattctgagaagaggagtgacaggactcgctttatagttttaaattataactataaattatagtttttaaaacaatagttgcctaacctcatgttatatgtaaaactacagttttaaaaactataaattcctcatactggcagcagtgtgaggggcaagggcaaaagcagagagactaacaggttgctggttactcttgctagtgcaagtgaattctagaatcttcgacaacatccagaacttctcttgctgctgccactcaggaagagggttggagtaggctaggaataggagcacaaattaaagctcctgttcactttgacttctccatccctctcctcctttccttaaaggttctgattaaagcagacttatgcccctactgctctcagaagtgaatgggttaagtttagcagcctcccttttgctacttcagttcttcctgtggctgcttcccactgataaaaaggaagcaatcctatcggttactgcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaaggtaaaggcatgtcctgtagggtctgatcggggccaggattgtggggatgtaagtctgcttggaggaaggtgcagacatcgggttaggatggttgtgatgctacctgggccccaaagaaacatttctgggtaaggtgtgcacacatctgtgttattagcagaaatgctaactgccaattcttttcataggtctgacctatttgttgatattttgttctgttttgtccattgcttctcttcgtcatatgctgctcctccagaatctagagactggagtagagggagggtgaagggacaaagacaaaacttccctctgcctgcccaagcttccatagagagaatcaaggcaatgaaatccaatcaatatcacacacaagtttcatgtctggttctcttgtgtgtacatgcaatgtgtgtttttataatatcttttcctactttgggtgtaaggataatatgagccttgagttcagaagcttttcgtgttttgggggttctggtgcatttaggcagagtattaaataactttatcaatattgtctatggtcatcagttgattcagatttttctacctcttcttcagtaaatattggtatattttggtctatactttcatagaaagcaatctactgtccctagatttgataatgtattggtatcaagttatgtaagagtctcctgtgattttgttaaactgttctgtgtctgtagttatattttctttttcattccttatgttgtatatgttctcttcctctcttttaaaaataatatttccaggagttttcttgattttattggtcttgtcaagaattttcttttggtttgatttatcaatctcttttttctttctgttgcatcagtttctgcttctactttcattgatttattccttccttctaatttcctttggttcattttgttgttagatttttgcttcttgagttgaatgctgaaatcatttattttatttttttgtcttctttaaatgtgtattataaagatttaaatataatacatagattgtggctgtgtaaacattaaatgtggtcatgttgtacatactttatattctttttggttctttctgtttggctccccaccctctttccacatcagtccccttctcccccacctcagctaggtaaccccagtatgataatatatattcacatacacatacacacacacaaaggttttcttggacattatttgttttataaaattgggacattatacacacatttctcactcattaacacgtactagaactctaagtcaattggtatagctttaattcattatttttattggctatataagattctatggtatggctgtatcacaatttagtcaatatgttcactttattccagtttttggctactatatcctatatcattacatactggtgcttttacttctgttgaacaaacttgcaagaggaatattaatggaacgaagggaatgtttccttctaagttttaatttccaaagaggtcagaacttttcaaacatttctaccatcgaagtatgaaaatggccttctctctgcattcacatagcgataagttttatcctgtttttaaaatttgccaattttacaggtgtagagtgatattgcatcattactttcattgtgttatttttatttctaataagttgagcatctttttaaatgcttgttggctattggatttatttgggggatttaattagtcatatgatttgcccattattctttggactctttcatttaaaaaaattatgagaacccttttattattacaaatattaactctttgtcatgtatattgcagttttccccaagatctattgtttgtctgttgactttcttataacttttaccaaaacagtttttaatttttataatcagagatatcttttctttcatatcttcagagtcggcaaggttggttaaaaatgtttcccacacctcaagattgtacgtgtaatctcccagattttcttgcaagatgtttactgtttcgctttttatatgcattgcttcaattatctgctaattacttttgtcatatggcatgagagagggatttgtctagttttatttccatccagatcaatagcctattgtgatggcaccttttgccactgatttgaatcaacacattcatcatataaagttctcatatatattagcatatatttctggattcattaggctgtttcactaatctactattatcttgctatgccagtaccatagtgatttgattacagtgagcctatgatatcttctgatatctggtgggtgaaagcaatcctcactattctttttgtacctttcttagctattcttagacactttattcttccacataaaactgttaagatatttttcaaattaaaaagatccaagccctgttgtgattctaactgcaatttcattaaactcagaccttaattttattaatgtaataaatttaaatatttttcttattacatttatctctgtgtattttataagtgtgatgctattgttaataagatagttttctcctatttccatttatgagtgcttagtaccaaatagagataagctattggtttgtgtattttcagctttttcttttgagcctgggtctcattttgtcacccaggctggagtgcagtggggtgatctcaccttactgcagcctcaacctcctggattcaagcaattctcctgtatatcagccccccaagtagctgggactacaggagcaggccaccatgcccggaaaatttttgtatattttttagagatgggtttttgccatgttacccaggctggttttcaactcctgagctcaagcattccccccacctcagcctcccaaagagctaggattacaggtttgagccaccgcacccagccattgtatattcatcttaaatctagctaccttaccaaatttgcctattaattctagtaattttaccctaaagtctctgtgagtattgaatcatatcataagttaaatgagacagattttagctcatttccaatatttatagccagttatttcattttcttatcttattgaatttattagaaaacaagagcaaatgttaaataataacaatgaaagtgaacattccttctactctatgattttacttgaaataatttttgtattttgctatttagagtaacatttgctgttttggtttttgtaaatggtgtttattctattctcatttgccacaaaatgtttatcataaataagttttcagcagctggtatcatctgaattgtcttctttgatatgctgatgaacaaattatgttcatagatgtcctgacactaaatacccttacattcttggagtaaaatctactattcatggaatttgatcattagtgggttctatgtactatttctttagactattcttagtagattttcactactcaacctactaataataataaacaaagttttgttggctttatcaaatgaattgatgagtactccatctttttctattgcttagaatagcttaagtaacatttgaattatccattgtctaaaagttaggtgagactcacttatgaatccatttggtcctagtggcatttgcaatatctttaatcacccctccaggctcttctatgataatcagtcaattcaagtttcaacttccaataattatatacctttctaggaagtaactttatttattttttcaattttgttgccacagtgttgcatgtagcactcactcatgattcttttactccacattatctgtagttatgtgccctttcttattcctaaattcctctatctttgctatttatctttttttccttgaataagcttgccaatgacttgtctattttgttgctggtggtgctcttttcaaagaatgggcttttggattttttttttttctagttggtataaagcatttttattttcactgagcagaaaaagaagctattgattcattaactgtgctgctttattggcatgtagctatgcactgttcacacattaatatataaaactcgtcagtctgttttattttgtctgatgggaaaacatgaacagtgagatttcttatgcaaaaagtgaacagttcaactatgctagctccatatacctttattaacattccagagacttatcctctcaacatgatctgatttctgtaggataacttttcaggaaaagtattttctgatcagtgaagcttggagatataaataagcaatcggccaggtatggtggttcatgcctgtaatcccagcactttgggaggccgaggcaggcagatcacctgaggtcaggagtttgacaccagcctagccaacatggcaaaactccgtgtctaccaaaaaaaaaaaaaaaattagctgggcatggtggtgctcacctgtaatcccagctactgaggaggctgaggcaggagaattgcttgaacctaggaggcggaggtggcagtgagctaagattgtgctcagcctaggtgacagagtgagactccatttcaaaaaataaaaaaataaaaaaaagcagtatctctcatattcattaactggaccctgactttcttaaagctcaccccaaagctgaagtccatgaaggcactagttctcaaacttcagtgtgcataagaatcactcgggaagcttattaaaatttacattcctaggccccatcctcagcaaactatttagtccccaggtaattctatcccaccccaccccagctttattgtggtataattgacaaataaaagttgtatatatttaaggtgtacaagataatgttttgatgtaagtatacattgtaaaatggtatagcatgaagggttttcttttcatttttttcagaatagtttgtaatatcttctttgatttcatctttgataatctagacgtatgattttaattgctttttaaatttgtttatcaagttagtttgtagtatttgggtcaacattgaatatcctgttaatttcctattgctgtgtaacaaactacatcaaatgtatcagcttatgacagacccatttactgtctcacagtttctgtgagttagaagtccaggtggactcagctggatactctgtgcagggtcatacaaggccaacaccaaggttttaatagggctgcactccttagtgaaagctcttggggagaatctgcttacaggctcatttggaatgttagcaaattcagttccttctctcactttccatgtagtgccctctaccagcaatggtgcatcaacactctctcatgcttggaattgctctgacttcaattttccgtgcatatctctggccttttttgcctctctcttttacttttaaggactcatgtgattacattgggccgacctgggtaattcagaatactctccccatctcaaggtcagctaatcagccccttaattccatctgcaaagtttaatttgccacataatatatttttggacatgacaccaaggagcaaaggtgatgtgggccaaatttttacctgccacaggtatagtttacatacaatgaagctcatcaattttaaatatgcagtttgatgagttttgacaaatgcatacacttgcataaccaccaccctaatcaacatgcatttacatcaaccctcctgcaactttttaatgagtctctcccactgacctggcctcagccaataaactgctatctggaagttacagatttgttttcacatgttctagaattttacatcagtggaatcatacggtatgtattcttctatggctttttttcttcagcatcatgatttggaaattcatgcaggttgttgtataaagtatttctatcctttttattgctgattactgctccattatgggattatatcataattttggattatttccagttaggagcaaatacaaataaacctgctatgaacagtgctccacatgttttgtgtgaacatctattttcatttatcttagttaaatatctaggagtggaattgctggatcatatggtaagtgcatgtttaagagaaactgccagacagatttcttgaacgtaccattctatactcccaccagcaatgcatgagagttccagttgcaatatatcctggacaacatttgatgttgccagtacttaatgactgcacagtggtatctcactatacttttttttttttttgagatggaatctcatcccatcacacaggctggagtgcagtggcgcaatctcagctcaacatctgcctcctaggctcaagcaattctcatgcctcagcctcctgagtagctaggactatggtcacacgccaccgtgcccagctaatttttgtatttttggtagagacggggttttgccatgttggccaggctggtctcaaactcctggcctcaagtgatccacccgcctcggcctcccaaaatgttgggattacggcttgagccactgcacctggttatacttttaatttgcgtgtctctgatgactaaagatgttgagcatctttgcatgtgctaattagccattcctatatcttcttggaagtgtctattcaaatcattggtcctttgtttttaaacgtagtttcaacttttattttagactgaggaggtacatgtgcaggtttgttacatgagtatgttgcatggtgctgaagtttgggttacgaatgaatgatcctgtcactgaagtagtgaacatagtacccaataggtggtttttcactccttgctacccttcctcctccctctttcctctagtcgtctccagtgtctattattctatgtccatgtgttctcatcatttagctcccacttctaagtgagaacatatggtatttggttttcagttcctgtgttaattcacttaggataatggtttgccagtttttaattgggttgtttgtcttgttattgttgagttttgataattttttatatattctgggtacaagactattcagaggtacctgttttgaatgtttttttccaatctatggcttgcattttcattttccaaatggtgtctttcaaatagtggaaatttatagttgtagttaagtccaatttagcttttcttcttctatgattcatgcttttttttcccctgtcctaggaaatctttgcccacctcaagttcacaaagcctttcttctgttttcttctagaacttttatcattttagcattagtatttaggtttataatacattttgagttaaattttctgtatggtgtgacttttctttctctattgaattcccttggtgcctttgtagaaaattaaatgactgtatataggcaaatctgtttatggattctctagttccatagatgtgtatatctgtgcttatgccagtaccagattgttttgattgttgtaactttatagtaagtcttaatatcaggcagtctaaaacctccaacttacttttttattgaaattgcttttgatatatttaggcttttatatttctgtattaattttatagtcaactagccaactccaccaaatagccaactgggattttgactggaattgaattgaatctgtagatcaatttggggagaattgacatttaaacaatactgaatctttcaatacaacaacatggtatggctttgtttctttaaattttctttaatttccctctaggatattttgtagcctacagagtagttcttgcaagaattatattaattgtatccccaagtattttgagggattcgatgctattgttaattgtatcatttttatttgttttcgttttccaatcatttgttactaaaatatagaaattcaattgatttttgtatattgaccttgttcactctaatcttgttaatttgcattttagctctagtagcgttttgcacttcttttagaatttctacatatacaataatgttgtctgcaaataaagacagtttgcttcttcctttccaaactggatgctttttattttttttttcatgccttactgtactggcaagggcctccagtacaatgttagatagaactgatgatagcagaatccttgtcttcttcctgatttcagagggaaaatattcattattttaccattaagtacaattacttgtaaattttttcatagatgccctttgtcaaattgaggaagtttccttctattcttggtgtgagagtttttatcaagatttgatattagattttgtcaaatgctttttctgcatctattcaaatggtcatatggtttatcttgtttattctgttatggtgaattaccttgattgattttttaatgaggaactagctatgtattcccagggaaaaaatccacctggttgtgacatattacattggtaatattttcgctatggactgaattgtctccacctccccccaccccaaattcatatgttgaagtcctaactctcaagatgattatatttggagatagggcttttaggaggtaaacaaggttaaatgaggccataaggatggagtcctaatctgataggactggtggcctcataagaagagagaaggttctctctctacactcatgcactgaggaaaagccatgtgaacatacagcgagaaggcagccatctaccagctgggaagagggctccactagaaactgaccgtgctggcaccctgatattggatttccagcctccggaactgtgagaaaataagtttctgttgtttaagtcacccaatctctagtattttgttatggcagccctggccaactaaaactgttttgttaagggttttggtggtgatggtggttttttagtttttgcgtctgtgttcatgatggatatttggctgtgattttcttataatgtcattgtctggttttgatataagagtggtattagtccgttctaatgctgctatgaggacatacccgagactgggtaatttataaaggaaagagatttaatggactcacagttccacatggctggggaggcctcacaatcatggtggaaggcaaaggaggagcaaagacacatcttatatggcatggtggcagacaagagagcattgtacaggagaactgccctttataaaaccatcagccctcatgagacttattcactataatgtgaacagcatgggaaaaccccactgccatgattcaattacctcccacctggtccctctcacagcacatggggattgtgggagctacaattcaagatgagatttaggtggggacacagccaaaccatatcaaagagtaagactattctttttttttttttttttttttttgagacggagtctcgctctgtcacccaggctggagtgcagtggtgcgatctcggctcactgcaagctccgcctcccgggttcacgccattctcctgcctcagcctcccgagtagctgggacgacaggcgcccgccaccacgcctggctaattttttatactgatagtagagacggggtttcaccgtgttagccaggatagtctcgatctcctgacctcatgatccgcccacctcggcctcccaaagtgctgggattacaagcgtgagccaccgcgcccggctgactattcttataaaatgagttgagacgtgttcactcttctatttaatgaaagagtttgtgtagaattggtatcatttcttttttaaatgtttattcaccagggaaatcatcttatcccagtgttttttgttttggtttggttttttttttaagggtcttaattgtgaattctatttttaataggtaaagggctatttgaattttctatttcttataggataaattttaataatttcttttaagaaattccatttgagactgggcatggtggctcacacctgtaaccccaacactttgggaggaggcagcaggattgctctaggccaggagtttgagatcagcctgggcaacataacaagacttgacttctacagaattttttttcattagccaagtgtggtaacatatgcctgtagtcccagctacttggaaggctgaggcaggaggatcacttgagcccaagagttcaaggctgcaattaactatggatcatgctactgcactccagcctgagcaacaaagcaaggctctgtctcaaaaaaagaaaagaaattccatctgagctgttgaatttaatagtataaagttcagaatatttccttaccattttttcactccttggaggtatgatttacatactgtaaaaatcacttattttcagtgtggagattcttttcctttcctaaatctccacatttttattgacatatactttacatatcataaaattcaccatttgaaagtgtacaattcagtggtttttagtgaatccgtaaagtgtacaactatcatctttatttaattccagaatattttcatcacctcaaaaagaaaccctgtaatcattaaacagtcacttctaattttcttcctttccccagcccctggcaaccattaacctactttccgtcactgtggttttgcctattctggatatttcatgtaaatgaagggataaaatatgtggccttttgtgtctagcatcttttgcttagcatgttttcaagattcttccatttttgcagaatgatagaggagttaaaataagaaaataaagatatagtaagaatgaaactattttcattttttaatttaaaaaaatcttccatgttgtagtatgtatcagaatttaactcctttttatggctgaataatactccattgtatggatagaccacattttgtttatccattcatctgttgatggacttttggattgtttccccttttggctattatgaataatgctgctatagaacattcatgtacaagtctttgtgtacatatgcttttatttctcttcggaatatacttaggaatataattgctaggtcacatggtaattctatgtttaacttttagaggaactgccagactttttcaaagcagctgcaccattttacattttcactaccaaagtatgagtgttccaatttttccatattcttatcaacacttgttactgtctgtctttttaattatactcatcctagtgtggataaagtgatatctcattgtagtttggatttgcatttccctgatgacttacgttgttgagagtcttttcatgtgtttattgaccatttgtgtatctcctttggagaaatgtctatttaaatgctttgcgtgtttttaattggattatttgttttttagtactgagttgtataagttctttatttattcttaatattatacccttatcagagctatgacatgaaaatattttttcccattctgtgggtagtattttcactttcctaatagtatcctgtgatgcacaaagtttttcattttgatgaaatccaatatttatttattttacccctttggttgcttgtatttttgttgtcatatctaagaaatcaatgtcaaatcaaagatcactaagatttaaacctatattttcttttgagacttttatagttttagttcttacattgaggtcattgatccacttggagttaattttggtatatggtgtgaggaggggatccaagttcgttctacagcctatatagcctgcagatgagcaatgttagtgaccttgaaagtagaggcccaggttgtcagtagcctggcatctaactaaacaaccatttatccattaaagttagccctgttaacaattaatattgagataattttacttaatacactgtgtatattagtgtccatctagcatgcagcctgaggcacagagaataatagtttgagtataaaattgaattgaatggaatacatcattaatttattatctagctttctgttattgtataggcagtcacatgtatttaccagaaaaaagttgatagaatttttattttaatgaaacccttttatactttagattattttgatgctgattaacaggataagctgactctggacacatcctgacagcctctgccaaggtttgaaataaacagctgggaaaattcagttttatattatctgttcccgcagctgctcagtttcttctaaccacaggtcagggaatataataggttttccgattagttttagataaaatgtgaaagaacagttcatgtcaaggacaatggttgccaaatatatttggcaggatttctatattgaatcccaaaggaaatacacaaacaaaaccccacaaaagttaggaaggagtaaaacccaggaaccctggaacattttgtcatttactatgcagatttgcctgaaagtgagacaggcaaataaatcacatgtttctgccagcgtggaaaatattcactcaaatggcaaaggtctcaggctggggagctggatattgtcctgtaataggttcatctcagaactgaatcacacacttggagggtgttaatgctcttaggaacatctagttattccctttgaatagagtcctgtcctgaatcacatatacttgacctagggcctaggcctttttgtttttctgtctcacaatcttgtttctccatcaattatgtgttttcactcttccctcagagagggaaaaagtgtttctgtgtgctcttgatcctgttccctctctgatcttccaatctattgctctataacatattttatatgtgtcttatatcttcattttagtcagaaacatttatttatttatttatttatttattttttgagacagagtctaactctatcccccaggctggagtgcagtggcatgatctcggctcactgcaacctctgcctcccgtgttcaagcgattctcctgcctcagcctcctgagtagctggcattacaggcatgccccaccacgcccagctaatttttgtatttttagtagacagggtttcttcatgttggcccggctggtgtcgaactcctgacctcaggtgatcctcccgcctcggcctcccaaagtgctgggattacagatgtgagccattgggtctggcctttaatcagaaacatttaaagtgaaagcactgtggtaacttatgttgaaataccttagaaatcaatggaaactgcacagagagggggtaggatagacgtagtggaaccaaggatatgatatggaaaaaggagaaaggtagcaaactagggatgagttggtgaatgtggaagggcataataatgttaaatgactgaaaactacataggcttatgttaagactagtgccatggaaatttttagaggtagatgacattagagtatgtttaaatataaattaatgttcttgcagtgagccgagattgcgccactgcagtccgcagtccggcctgggcgacagagcgagactccgtctcaaaaaaaaaaaaaaaaaaattaatgttactggttgtgttccctagatgtagactctgagatgaagattaacatgcaggaattttatttggagtgttcttgggatcaacacctgaggaatcagggataggcagagggagaagcgcgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccaatggctgggactggggagttctttcctagactgccatccgggcgcccctcaccctcttgctgctcagctccaggtcgtcgtgggttcagggctcagctgcacgctcctgcccgcgccctgggcgtgatggcacccccagcccctgccattcttccccctcaccccctctccctgccactgctctgcattgccctgggttagcctggcggggccaggtggcacccgccgtatactcttgcctttctgctgcaggggcctttctgctgcgggtcccagagctgcagggaggggcggcagagactccccacgtggctcattggcgggggtgctaatcagagttcttttgctgccactctttgattcccaaaccccatgtaatcttcttagtggggacacagaatcatctttgaattcatacatatacagcaccttggaggctggccctccatcctcacagagacctgcctccaagctggagttctacctgtgcctggttgtggacccactccctcatctcttttgctgtacaatgattccccaggtctacacggtgctatatggaattccacatcagtgaatcaaatcctctgtaagatttcagatagtggtgctggctaaggccctgaagggaggaaaggctaagttacgccaagattaggtatcacaatgaagtcctgtcctttctaggatggaaggagttcagtgtgtctggccaccgagaagctggtttgtctctgtgatggacaataccatattgcagcaatccccaacctttttggcaccagggactggtttcgtggaagataatttttccagagactttggggttgttgggaatggttacggcatgaaactgtccgcctcagatcatgcggcattagttaggttctcataaggagcacaaaacctagatcccttgcatatgcagttcacagtagcattcgcactcctatgagaatctaatgcagcagctgatctcacaggaggcagagcccaggcggtaatgcaagtgatggggagccgctgtaaatacagatgaagctttgctccctgcctgctgctcacttcctgctatgtgaccccattcctaacaggccacagaccagtactggtcaggggcccaggggttgggcccaatatggcatattgggagctcagcattgatttttgttgctggcaggttggactttggtggcaacagtagctagatcagccttagtcagtgggaagccacgcttttgggtccatgcattaattctctccctgctgctgtagccacttagctcatgtcttgccagtactgcgatggcctatgcagaggctagctgatgtgaattgccagagtcatttttatatgtgttgttggtttgtgcttccttcaagatggatgctttctgttggcattaacgtattacttggagatttttctagtttgtgtccactcactaatatgcctttgtcccaacttttttctggaagagcttccttatcagtacgctgggccctggccctcagccagtacagaaagtcatttgtcaaggccttcagttggcagacgtgctccctggactacgtgctttctcgggtgtcccagaaaccctggaatggagtgaaatgcagggctacgtgggagagcagggaggcaagaattaagtcggccccacctttgcccaactcagtgggtctccttgagagaggtctgcagtttcaaggagacttttcagccaatctgctgcgagatcctgtgaaggggtgtgaaggtcttcctctgtgactatagattggccagtctctccttgtgtgtccaacagttttcattatactttatgtgaattaatgcaaaactgctaggtttaaactgctcaccattttagggatcccttctggattttaccttccttaaggggaaattttcctcctttcctcagttcatcctttctgccttggctttgacgtggtctggaggccacagagcctcctcctgagaacctctctctggtgtgtctgtttgtgtccgtccctctcctttcgatcattccctgtggttcctgttgggcgcggctcccataaacgcacagagcagggtctgctttgtctgcaacctgatgcattgttatttctcaccaaaacttgcagtccaaacatcacatttccgggccacactctttgtcagagctccaggggcacaaccccggggacctgctggaaggtgccaccgtgacgtgtgcctagatgcgttttccctcagttaccacagcgttcctctggttctggtggctggagggtgaccgcgtgcttcatgaagggggtccttactgcttcgcatccacccttttcacggaaagcactttgtcacatgttttcagtgtttctaagcgattttctgccaatcttgtgtgctaagattgtgtggcagcgtttccacagatttatagctggcaatgaattctcccaaaggaaatcagacaaaataaaatgtttccaacattgttcacatactgacaacttatgtgcttccttgggtgattttacaactttttaagcacatgaataaaaattattgtctgcttttttctccttttttctctcttttttttcttgcatgcagaaagtttataggagggggatcctctggatcaacacccatgggggagtgaaggaagcaggattgggtaaaagaagttgaggtgatacagtctgaataaaggtcagtcccacagggagctcaagctaggatggctctgcagagatgttctctattgaggcaagttgtctggacctatatagtcccacctttaccaggaataaggcatgagtttggatgtggtgactgacttcagccaaaattggttctcagagaggaattcagattagagttgtcagctgtcagcacacccagcagcttaggaaataagtgctttagtcctgaagcggtgaatctggacaccagcctccactgtggtccaccctttctgctgctcagattcatttgcttcataagttctggaatggttccttcaggattctgatgggctccctttcctggggaaacaaaagagaaaggtttggaacacagcacaactcctgctgctttagcttttcttgagtctgcaactggtactcatcatcttccccttctactacccattctagatccctccccccaccaccctctcaattcatacttctgctgctccaagtgggttaccagataaggtatctggtcatcatgccctttgtaagccatgactgtacttgtccatttatcatcaacattgaacaagggaatactaagagatacccaggcagatgacctggctgccaaatatattctcctctgtctccattgtgtaatgtcagcccttcctcctgatgatcaggatcggttacgcttgccaggatagtgactcttttccttacctcttggtctcttaatagtgatctgaagtaatatgatggcaaccatagtttcaagtttaatgagactcttggtgtgtccactggcggacatattccccttttaagaaccagtacttctaaactctcagagcccagagttgggataagaggcatagtttccctaattgggtcactgggagtaatggtagtgtgaggctgctcctacttacactccttgttttccaaaaccatatattttacttcgggacacaccccactaaacgatggccattgatctagagtatatactgcatcctgcaggatggtgcctcgtccttaggtattatgtctaagctagtgcctcagctgtgccttcaacaagctgtcctaccactctatcaagtgggtagcttctgggtagtggattccatggtcatgtatcttcttgctttaaagtaggtctcttggtctgatgcagtgttatgtaagatcaaatattctgtgaggccttgaatggtggtgtttactgaggctcaccaagcaactgaatgattttcttgagaaatggtgacatatcagagccttagctttggtctctgttactggcaagttgaacattaacaacatcagtagctagatctgtattgatgagtccatgatgttgggcccatgcatagcctctgccatggctcctcctttcatacatccattttgtaagaattggggcaccaacagcagagactggtaagcatcaaagtggctaagtcattcagtctacttggttgtttagtgctgtttctgtggctgatgttcttttcatttattcattctgtaatgcgtatcctttgtagattcaatttccttctctctgaacaacttctttggatatttattgaaaggcaggtctactgtcaataaattccttaatttttattgtctgagaaagtttttatttctccttcatttttgaaggatactttcacagagttcagaattttaggttgactgttttttctttctctcaacactttaaatatgtcagtgcactctcttcttgtttgcatggtttctgaggcgaagttggatgtaatttttatctttgctcctctatggataaagtgtttttccccatctggtttcttacaacattttttgtctttgattttctggagtttgaatataatatgcctaggtgtagggtttttttatttgtttgctcgtttgcatctatctttttttttttttttttttttttgagacagaatctcgccctgtcacccaggctggagtgcagtggcgcgaactcggctcactgcaagctccacctcttgggttcacgccattctcctgcctcagcctcctgaatagctgggactacaggcacccgccaccacagctggctaattttttttgtattttttagtaaagatggggtttcaccatgttagccaggatggtctcgatctcctgacctcgtgatctgcccgcctcggcctcccaaagtgctgggattacaggcgtgagccaccgcgcccagctgcatccatcttctttggtattctctgagcttcctgaatctgtggtatggtgtctggtgtctgacattaatttgggggaaattctcagtcattattgctttaaaaatttgctcctattcatttctgcattcttcttctggcatttccattatgtgtatgttacaacttttgtagttgttgttccacagtttttggacattctgggcccatgcatagcctctgccgttgttgttggtgtttttttttttttcagtctttttttctctttgcttttcagttttgattggaagtttctattgtcatgtcctcaagctcagagattctttcctcagccatgtctcatcaaccaatgagcccatcaaagacattcttcatctctgttacagtgttttgatctctagcatttcttttttattctgtcttagaatttccatatttttccttatgatatacatctgtcattgcatgttgtctactttttacattaaagccattagcatattaatcatagtttaaaaaattcctggtctgataattatgacattcctgccatatttgactctgattctgatgcttgcttgttcagtctcttcaaattttgtgggttttgccctttagtgtgccttgtaatttcttgttaaaaggtggacatgatgtactggctatgaggaactacagtaaataggcccatagtgatgtggtgagatggaaagaaagaaaagatgctcaacatcactaatcattagagaaatataaatcaaaactacaaagagatactgcctcacacccattaggatggctactatcaaaactaaaacagaaaataatgaatgttggtgaggatgtggagaaattggaacccttgtgcactattgcaaatgtacaatagggcagtttctctaaaaattaaacagaattaccatatgatccagcaactcgacttctggctatatatgcaaaagaactgaaatggggtcttaaagagatatttatacatcaattgtattagggttctccaatgaaacagatccgtgtgtgtgtgtgtgtgtgtgtgtgtgtgtgtgtaaatatatgccaatggtaaaagtacagggtctgagtcagaaggcagaaccaagaatgcttatgtccaagggcaggagaagacagatgtcccagttcaaacagggagagtgaatttgcccttcctctgtctttttgttctattcaggccctcagtggaatggataatgcccacccacattggtgagagtgatcttctttaccaattcacatgctattctcttctggaaacatcatcacagacatacctagaaatactgttttgccatgtatctgggcatctcttagcccagtcaagttgacatataaaattaaccatcatatccatgtttataagcagcattattcacaatagctaaaatgtggaagtactgcaagtgtctattgacagatgaatggataatctaaatgtggtatatacacacaaagcattacgaaagaaggaaattctgacacatgctacgacatagatgaaccttgagtatattacgctaagtgaaataagccagtcatgaaaagacaaatgctgtatgattccacttatattgggtacttagagtagtcaaaatgatacagaaagtagaatggtggatgccagagactggaggaggtgagagttattgtttaatgtttatacagtttcagtttacaacataaaattaattctggaggtagatgggagcatattacacgttttctttttggagatgggatctcactctgttgcccaggctggagtgcagttttgtgatcatagctcactgcagccttaactgtctgggctcaagtgatcctcccaccccaggcaccaaagcagctaagaccacaggtgcacaccaccacgcctggctaattattattatttgtagaggccaggtactgctgtgttgcccaggctggtgttgaacccctgggctcaagtgatcatcctgccctggcctcccaaagtactgggattacaggtgtgtgccaccacacctggccagaatatttaatgctactgaactgtatatttaaacatgcttgggctgggcatggtgcctcatgcctataatcccagcactttgggaagccaaggagggtggattgcttgagcccaggagtgtgacaccagcctgggcaacatggtgaaaccctgtctctacaaaaacattaaccgggcatggtggcacacgcctgtagtcccacctactctggcggctgaggcgggaggatcactcgaacccgggaggtggatctcgccactgcactccagcctgagcaacagagtgagaccctgtcaaaaaaaaaaaaaaaaaaaaaagatttacgatagtaaattttatgtgtattttaccacaattattaaaattgaagaaaatccccatgggtcactggtttaccaatttagccattttcaccatttttagattgcattttccttctctatctcagcattctgactaaaggaaaagcaaaatttcttacaagaatgaatgattctccagtgtggctgctcctgaaaggaacaatgagacttttgttatttcaccacaagactgagaaagaaataaacaagtgataaatgcccagaccccttcttattcattccacatcctggtaatctgaggcatggtgtggcttttactccaagcatatgaatacttacaatcagaagctgcctctcctttccctcactttatcattattgccatcatttatgacaatggagggagtgtctcactggatgatatttggggttctttcttcagtggtccgccataccaagcatttatttgtgctgttctccatctttcacatctaccacttttcaaaagtccctgagagtcaataagacatgcgactcgaacaactgcttcacatctaagtgtatgtctttaaaaatctctccttttccatgtttatgtctgatgtgttttgttatggcaaagtggcatgtagtatacggttcataagtgaatcgatgtatatctgtggagggcaaatgctcaattttagatctacacatgaaagcttttttccagggcaggagccttgctttctccaactaagccttaattacccaaatgcccatgtgttgtgcctttggcttgttgaaatgataccaactggtaaaatctgatgggagataaaagttagatgtccagaagcataaaagtcaggaagagaggctctttatggcatagagaaagctgcagaactgctccatggtgtgcaaaactcatcagcacatgaaactagtgagtggagatagtcaccttcaaccactttgtaatttctaccaattcacttggggccagtgtcccttattcaccaagattcacattggtccttttgattatttggcgtgaggaggcccccagacatgctaaactgtcatgcagggagagaggaaaagttgggaaccagcctttgcttaaaagggctttgacaatggaggcaaataataacattttgggaacatttatataagtaattatataatttctgattcagtagctggttcatgaataaatgagtaattgggagtatctgagtggagacaagaatgaacattaatgtaggactgattctgaattacagcttctggcactagtaggtttcaatatacatagtctgctgaaaggtaattttctctgtgatattcctggtatccctaaggagggaagtataattttaggtacatactgacaaaatttgaacacaaggtacttagatgaaagttatagtctgttttagagatgaaattgaaggatgcagtagctattgctttggcaaaggatttttggctgatgcagtgtatggttattgattttatgattcttatcatatggcacctaatgtatcagttgagttgtgaaaacagtgtttcggtttaatggatgttagggatttatatacaacttcaaatttgcctccttgctaatagtagaaaagagtagtatggaagcattacttccagctgctttttgaagtgtccaccaaaatgaacgactttttcctttcttcacgcagatttcctcctagagtgccaaaatcttttccattcaacacctcagtcgtgtacaaaaagactctgtttgtagaattcacggatcaccttttcaacatcgctaagccaaggccaccctggatgggtaatgaaaacaatgttgaatgctatttatgaaattgggtatcttattttctatcacagattccccaatcttgaggttgcagttaaaaagtgcagctgccaaagagaatgtttccctaactgctacctatagggaaatacactgactgcattttctgtctttttgctgggccgtcttcctctgcttggtctatgccaactgcttacctccacttagatgtcaaataaagtatgtaacaacatgttatgacaggacattttctgtcttagaattgttgctgagaattataggtgggaagtatccccttattctaaagagagatatcagcctatcgatttagaacttgttcaggtagtagtccaaaattggttctgcaacccttaggccctgactcacctccaaccttgtataaaaaaaggctaggaacttatggaagactttagatttgaatatttattatttggagagcctcttcggtgttttatgtgttgcttaccccatggggagtgggaggcctgtccctcatgtcaaggtataatgaaggaggcttcaggagaaccacttagaagactggacaaggtacctatggaacttgggagacactgaccactgcctggtttttatctggataaattttcaaggtcagaggccaaaaggacttctcctgatggaatagcagggggagtgggcaatagtgggagctaactgcactaccattgttaggtgtaaggccaggaaggtcactgaatgggacttgtcttacaaagactctgcctgagaggtcttcctgccaggattagataaccccaatagaaaaagcctgtatgggttgtactgccagaagcagaatctgagaggagagatacaagtgaccagctggagaaggtatatcccatgccaagatcaggagcagtggggtgtctccttgttggcagggagaggtctccaaataactcataagttccctaagaaagaaaggcagaattttggtatgtgtcacaactagggagtactaatgccacattatcactgctccttccaagaaagactttgtcattgtgcctatttgtttttaccctcccccctcctttccacttgctcctaccttggcaggtccagagacacaaaggtgagttggggaggaagattaggagaggaaggtgggaaagcagcgaagctgccaaaacaaattacctttacatattgcagatttctggggctgtcagaatgtagctggagaaggaagggaacttgcaattgcagaagacatcaaaaatttggtattagactggactggacttgttagaacctaagagtgatactgttggttaatacctgaaggttactggaaaagatttgggatcaaccaaagtgcaagaaaagggagatctcacataaagtaattaaaagcagtggtctaagaaaaataaggctattttatgtttttatcccactcaatccagttcattcaacagactgtttataggcattttatacttagtgtattcataaaacagagctcttaattttcctcctgattttctgtcatggcctgactaacaacccagttgcacaagccaaaatcataggagttttctttgactcctctctttttttctatctccacatcatatttatgagcaagtcctgttgactgttcctccaaaacaagttccaagtcttcttattttacttcttgtaaaatccaaattcatccaaattcctgtggcctgcaaggtcctacatgttatgtttcctttttgaccatattttctgttactcctctgctgattcactgtgcttcagccacactttacttgactataccaaacttatttctgcctctggacgtttgcatttgttttatctgttttcaatgctcttccactagatctttgaaaatcttgcttctttttcattagtcagatctctactcaaatgtcacctcctcagagaggcccttcctgactactacactgaaagtatcctctacctcctgcctcatcactttctagcagaccactatcttttatatttataacaacttgaaattttcttatttatttctttatgtgcttaatgtcttgagaatatgatctccattatctgtcttgtttgctactgcacctccagtgcataagacagttcctagaatatagtaggaactctagttgaatgaatgaatgaattgaatgattgccagaaatcttgcctcagagcaaccataaggttaggctgatgttggcagcaagcaaatactactttttgtcagtaattacaggggcatgcttctccactgtgaccttgactctaacttttggaataacaggttttctggagtactatccccaagtaacctttggcggacatctcattcttacaggtctgctaggtcctaccatccaggctgaggtttatgatacagtggtcattacacttaagaacatggcttcccatcctgtcagtcttcatgctgttggtgtatcctactggaaagcttctgagggtgagtaaaataccctcctattgtcctgtcattctatgaatagaacagtgagatgtgtgtgctttgtaatggtggcgttacaactcttttaaggtcctaactgaacattatgtgtatttcttaacatttactagattataaatatctcaagatagggaaatccatcttatttattgctgtgtccttagcatataacatattgcctaccctatagtagatactcaatacaagaatgagggtgtagtggacaccagtcattttttcttcctaaaattaaacatttctcacctgtataccccctaggaattgcttttctgaatatacttcaaacagaacctgccattttcttaaagcccatgcctccctagccatagcagttgatctaggagtgagcagttgacacgggtatcccacctccttggccacagttgattggtccagagatgggcaccttacccaagctaggccaatgagagtacttgcactagcattttgaaatttatgagaaaaaggacctattattaccaggtaatcctatacttaggggatggagcccaaatataataaaatcaagattctactacttcatgtatatcatgtgggccatggatcttataggagtcttaagggggtgttggtcttgtccttttcttagttgcctagctctttgcaggcatggtgcaaaggcaggacaatctacctttatctgctccttctataccactgatcctaccctaaacatgtagctgtataatcagagacaggaagccatggcaaatctggagggtctcggcttggctatatcttaaagagttacatgtattcgtagttcaacattggggaaattttccaaaaattggtggagaaacgagtggccaatgcaattttatctttttttttctgctgacatcagggagagataagagctttaaaatcacaattatggggagataatattttaaaatccagctcaagttaaacccatcagaaaaggtaacaccttttgggacccccaaatggccacatcttatccaatgaggggacaccaaccatagagtctatactgcacagttcaaatggtagccatgagctatcaggcacttgaaatgtggtgagtcctacttgagacatactgtaaaatatacaccagatttcaaaggttaagtacaaaaaagactaaaaatatctcattcattgtttataagtacaagttgaaatgcttatatttggatatactaggttaaacgaaatacattattaaaataatttcacctgtttctttttacttttcttaatgtgactaccagaaaatttaaaattacatatgtggtttgcattatatttctattgaacagtgaaatgtttagcatatgttgaagttgctgctcctgatgcagtggctcatctcagatttggccaagttcttctgtccaaggaaaactaggttcaacccattcctggagaggaacagactcaaatctttctgggctgggtcacttaccttggttaaatctgttctccacctattctaccaacaaccaaagggatggacatagctgaaataaaaatcacgcaatcacactgaatggtatctcacctcaggtgggccttcagcattgcctagccattctactgctacatttcccctaatccatttactctccctctccccaagacagctataatgtttcacacattgttagcctctcattgaacctccaacatgtgctcccgcccctgcccccaccacaacgtgagccttgggaaaaagggtatttttttcctaatgaaatatttcaaacaaagataaatacagaaaataatataacaaacaaacatgtgcccatcacctcactttgccaaatcttaacattttgtcatctttgcttaatttattttacaaaattaagcattttacatacagtctgtactcctctatggggctggcaggaaaaggctctcattgtcaaagttcaaagtaattgatcattgaaaaaataatgatcacattaaaaacaacacttatataatagagatacatattgtaatactcataaatgaaatgatatcctgtctaggattggcttcaaacacatccaagctgatgttacaatcattaggtgaattcctgatgtggaatttgacatttgtatggcgccaaaataatatcccagtgatttttttctgattgtaagtggaaatgttaactttagaatggaggtatcaggctaatccacaggtcagttttagtgtcactaaggatgggatggccagatattatctgcccctgatatggcacaatatgagggactcagcatcatctttgatatattttagccaaaaaacttatttaatttgaatctaatcagaacttaggcatattcaatagcatgggatattctacaggactacaagccaaatttctttcaccaaatgagtgtcagaaaaaaagggactactccatactaaaagagactatgggcctaaacaaccagatgcaatctgcagtcttaggttggattctgatttggaccaactagctacaaaggatgcctttgaggcaattaagaaaatttgaatattgcattgatattaggtgatattaactggatcaggtgtgctagtgtcattttgtttatgtgggcaatttttttttaaagatgacttctaaagtatataggagtggactatcatgaaatttgtaatgtacattaaaatgcatcatcataaaaagtgtgttgaaagaaaaaagtgaaagtagcagtgcaattctaagaataattttctaacatccactcacaaaaatattaaattctttatattaaacacatgaaaaagaacacaaatatatctgtctttcaagattcatctcaaattccacctccttcatcaagcattactgaagagtaggaagcttgtttactttttttatccactgtgttgctcgctccaagggcatagagacttctatcttgatctttatattttcagcttgtagctgagtctggtaaagaataagaactcaataaatatttgtgaataaataggtgaatatttccacatggtattataattatatctttatatgtctatgtcccccaccaaacatagtgttgtaccactaggaaagaacaaagtttaagaaattttcttaaatctctctttcttactgttccgtgaccctcactagtgcctaccaaagagtctgtgacaaagtgtatttgttgttgaattgaattaggcaaaaagatgcaataatggaagcaatttattatttaacagaatgtggagatatcaaccagaacctagtttttactgctcatgctagggttagtgatctcaagatcctctggagtatatgaagcttctccccatttgtggctgctgcttgttagtttttcaaattaagatgcagaaagtaggccgggtgtggtggttcgcgcctgtaatcccagcactttgggaggctgaggcgggtggatcacaaggtcaggagtttaagaccatcctgaccaacatgatgaaaccccatctctactaaaaatacaaaattagccgggcatggtggcacgtgcctgtaatcccagctgctggggagtctgaggcaggaaaatcacttgaacctgggaggcggacgttgctgtgagccgagatccagcctgggcaacagagtgagactccgtctcaaaacaacaacaacaacaacaacaaagatgcagaaagtccgtttcttatgtagaacctattggtgacaataaacttgacatgtttctttgagtgtacagtggatatagaaaggacaattttatttcttcctgctataggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaaggtaagtgtatgaaagcgtaggattgagatgaaataagcagagaagtacaaacaactgaatctatctataacagttagcatttgtgttccttcacctgaaagaggcttttttactctagcatcatgctcatggaaaggagaataatccagtttctgagagaagcagatatgcattctatataaccacaataaactctaagctgggatcaggaggagctgagttccagaattaaatctctctcctcaaagcattgctattttcctcttcaaatctgtgggctttatcagtagtgatttctactgtcctctgccttttgcaaactttgagctaggttccttgaaaacttcatggaggtaaacacatccaagtgtgtgatcaatggcatatagactggttcaggtggttagtttgtcatctgtaaaccaaaagtatataaaaatctaagaaaagtcagcatttatttatatgttactgaaaattaattaatttggattgaattaatatattctaaaataattctaatcaaacctgtttttaatttataccttagcataaattagggaagtaaattttgcataatttgtttttatcctattttttatggtgaaatcagcttcactgtaccttttccttgttccatttatcttttactgcataactccacaatttagtggcttaaaacaacaacagtctcttattatctctcatggtttctgtgagtctcatggaatttgtcagtgttttgacttggtggcctatctaagtgtgtctcatgaggctgtagtcaaacagtggctagagctgaaatcatcccaaaggtgactttattcacatgtctttgaccttggcttgatggtactctccacatgatctctctcacatgggttttacagggtagccagacttcttatatggtcctgagatagcccattagaagctgtttcacgatttctaatgtaaccttggaaatcactcacataacctacattctattagttagaatgcatcactaagaccagtctataaagggagactccaccttttgatggggaataggcaaagaatttattaacaggaatcaccatactctttctgaatggtgatgatgaatgtgattcaaaaaaaggatgggagcggggagtggagaagatgagaaaggtttgtagtttataatagtttcagatgaaagtatgatttctcatatactgagttcagtttcatagtcataattaatgagaaagtgccaaaaccacagtgtattatttatgggatgtaaaggctaatggaacaatgagatcatcaaaacattagtgtttacatatgacatataaagaaataagttaaaaacccaaatgattctttgacacagagttgaactaaagagtctacagaggttctagttccaggtgaaatggataaacacactccaccctttatttcccattgaacttaactataaaaccttgacaaaatgcaaagcccagatatttaaaaatttctaaaaagcaaatagaacaagtatatagagaaaagacactagaattgaaagtattaccaaacttgtgggggagtatacctttttccccactctagtattccttaacctgaattaaaacataactggagacttcgaagtgagtactatgttgcaaagagagctccaggacaaaccctctggggtttcaaggagtgagaaaggtaactctaaatgctcagagagcgtgggaggggaaatcccctagggtttttgtcctcttttccaccattctctcaagcttcagtcccaggttgcctgtggcaatgacagtggctggcaacagaaacctgccggagtaaaaacttagggaggggaacattattcttcattcagtacagctacagatctaagacattgggggaaaagcacattactttctctctgtctttccccttccattgcttgaccttagctatgatgtagttgtggaaattggaagcttctggttagaaaaccaaaaaagggagctcacagaactggaaagtttatagatgacagagagaaaagatcccaggaaagtaaacccataaagttgtgcattaactcctggattcacccccaacctacacatccaggtatgtagtttcagtgtcagatctgttttaaaccccttgcagtgccattgagtccaacgcagtggccagtctggtgcttgaggggaaatctcagtttcacagtcttcaacatgttccattagcctttacgtcccataaataacacactgtggttttggcactttctcattaattatgactatgaaactgaactcagtatatgagaaatcatactttcatctgaaactaacgcccacagaattccttaaaacatgtctgatggctgaaagcaaagatagaacattgtgagataggttttttaatgtatggtagatacaatacataaaagaatcatagcataacaagaggagggtaaggaaaactttatggtccattcaacttcattccaattcaaatggtaaaatgttgactctaagtagatgatagtgaaaggttaagtatgtattttgtaatccctagagcaaccaataaaaaattataccaagagacacagtaaaaagtcacaataaactaattacaatggtatatcaaaaatattcaaataactcaaaagaaggcaagtaaggagagatgaaaatcagagagaagaagcagtaaaatcataataaaatgataggcttaaatctaaacatatcaatacttacattaagtgcaaatggctaaaacacaccaattaaaaacagagattagcatactggatataaaagcttgaaccaattatatgttgtttacaagaaactcatttcaaaaaaatgatataggtaggttaccagcataaagatggaaaaggatatatgatgcaaacatgaatatgaagaaagttgaagtagtacaaatctgtaatcacaacattgatttttgccaggagtgccaaaaccattcaataggggaaagaatagtgtcttcaataaacagtgctgaaacaggtgaatatctgcatgcaaaatactgattgagtatcccttacctgaaatgcttggaaccaagaacgtttcagatttcagatactggaatatttgcacatatataatgagatagcttggggatggaacttaagtctgaatatgaaattcattttggatataaatcccttgccagttatgtgattggcaaatattttctcccactctatagtttgttttttcattcttttaatggtgtcttttataaagcaagagttatatggacaaacatatgaaaagatgttcaacatcattaaccattagggaaatgcaaattcaatcaacagtgatgtatctattagaatagctaaaataataatataaaattgccaagaatcctgtcaagaattcagagcaacagaaagtttcacaatgcacaatggtatagccattctggaaaacagaatggcagttttgctgcttggtagagaaacagtctctggcagtttcttgtgaaattagatgtacactatagagggatagcaggagggagttctttttggatattgaaatggatctgtatcttgacgatgatggggtttcatgagcttatatctttgttaaaagttatagacctatacaccaaaagaaaaagtcaatttcactataattgaaaatttatataaaagtaattagaatgttttaagacagctttatacgtattttaaatgtgtctctaaagtttttaatccagtacttctggtaaagatggcacagggtcttcctacttagccatttttccatcctccacctcaaccccaacctcgctgaaaaccaacaacaaagataggtaaaccataaatagagaaaatcgaataggcatggtcagctgaaaaagaagataaatatttgtggaccagaagcagaacaggaactgtgagtagtaaaaggggtggaaattacaggccaactgagatctgggtcaggaagccagctgcggtagccaaggagtcaggatgacaaggataaatagtgctccccaccagagggactgagagcccatatcatagagttgggctcttcttcacttgaaagagagctgagcacagctgctgctcactctttgtttagggccatggctttgtggaaactcagagtcctagaagaggggaaagcaaacccagtcctagaataggaactgaactaagttttcttggttcagtgggggaatctgcaatatccccaaggtttccattggccagtatctccaaaattccattctagggtatgatttgctagatagagaatagtgaacacatcctttgcttaatcaaccaatgatcacaagggacagcaaagatcactatagttcaacaaagtcagatttattggctcatggcaacaagagactgtggacacctccctaaacaaagggaaatactgtatagagttagtaaagaattttggggaagggtggaggttaggtgatatttaaatgaagcaaagtagagttgtgtgtaaagaaataaccatgaggtctagactgtgaagtgttctaaaaagttaacatagacatgaaaggttaagtcaaggcaccccttacctgaagcttgagctttaaattgagctgcttctttgtgtcaaagtaatttagatgacctaggaaagaatgagatgtttcattcttgttgctattagttcaaacatttctggcaggctgtgaattcagagaacaaacaactcaattgagtaagaaagcaagagataatcaaagcaaatagttggcattcagtgagtttatacagtggcaatgtgtccttgggagaaatggtgttgttaactctgcagttagctttatctatgtctcttatcccagcctgatgagtagcagcacacgtactgttgctttcttagtccaagctaatttttatttctaagcattaagggtgcgagagagagaaagaacggcaaaatgtcataaacaaaaatctttctactcaaaataagcctgtaaacaaaagtttccagtcaaatttaaaaaatatataattctaagaaagatagccaacaagctcaacagttaaagcatgaaacaagctagtttgttccattaaaaacttcagctatcgatatacacggtatttatttaaaatgtgagtataattagaagcactgtgggctattgaaaaaaaatcatgagtatagatgtttaatatggacaattgctattttactcaaaacttttaatttacaattgcagaagtataaaaagttacaagagtaacagaaattatctataatttcactattatcacacagtgtgtgagggcttgtattttgtaagtgtttttaatttttttctttagtaattcatttttatcatattttacacaagtagtggtcttcatcaaagttgaaataaaaaaattctttgctccagatagttttagaaacactgctataggagacctgacatcaaagccaagttatcaagagacagaagactacatttgttcttactgtcaagtaactgatgaagaactgtctcctcctagtgacaatttcctacaatgagattttttaaatagaagataaatgttctcacttctttttcagggagtctggccaaggaaaagacacagaccttgcacaaatttatactactttttgctgtatttgatgaaggttagtgagtcttaatctgaattttggattcctgaaagaaatcctctgctactattaagaggaggtgattatagaaagatcataaattacattactgttcaggaatgaaggagatggggttaaaaatgaattccaagaaaacaaaacgtaacctcagttccactggcagctatgaggtaagaagatagaggagctggataacggactggcctcatccccctcattaagactgtcaacaaatactttgggctctactttctaaatactttctcttatcttcatctattattaagtgcacaacctttggcaagttatttaacctctctgtgtctcggtttcctaaatggaaataatagtacatttttcataagattgttgtgagtgctgagtgatttcacttaagtaacctagagcactgtgtggcatagagtaggccctcaatagtgttagtacctccgcctcttcctcctcctcctaatgtaatcactatgtaatcatagtaacataatattcttcttgcccccttatcaatttacattgccatcttcttaattgaggccctcatgatctgtctcataactctcaaaggaagcttactgaagtgagtatctgatcttgtcactctagcctctacaatacttcagtttgccagtttcggtggctcatgcctgtaatcccagcactttaggaggctgaggtgggcagattgcttgagcccaggagtttgagaccagcctgggcaacagggcgaaaccacatctctacaaaagaattaaaaaatcagccggtcatggtggcgggtacctgtactccagctacttgggaggctgaggtgggaggatcacttgagcccaggaggtgaaggttgcagtgagctgtgattgcgccactgcactccagcctgggtgataaagccagaccctatctcaaacaacaaaacaaataaaataattcaatttcaaggtaaagtgcaaaatgcattatctattctctggtgacatttccagccttgttgtgttccatttcctgccttatcttccatgtcacccaaatatgtaatgctttttcttgcatgagacctctgcatatgcagtttcctctgcctggaaaaatctgtctccctctttacactaagtaagcttctcctttttctttaagtctgacttacttcagttatccccttccttaattccttctcccaggatgacctctagtctggattagatgcctgcttatatttccacagcatcttgagcttattccttatcatactatatcagtattttctactttatttaatatttatcttctttgatctcatatctttttcccttcaagcaaagtgaaatttcttctcctctctgctccctgtaacaccctactctcatctttattatatcactctttactctttattataattatcagcttctctgacgattccagctagagtgtaagcatcttgaaagcagaggctgtatcttcctctctatcatcagtgtctacaattagtagtgctcaataaatatgtgtttgaatgaatgaacaaatgaatggctgcctcataaagttttagcactagctaccagtccttcacacaaaggggtaactccagggagtcactgttcaatagtatttccagtgcttcagcccttatcaatttcagagacagtgttagggagctttcaggttcctggggtttcataaatataagctgggatgaagcaattataacggagacagggactgacagacagcctttttcctaggacaattttcttttttcttttcttttttttttgagatcgagtctcactctgttgcccaggttggagtgcagtggcacaatcttggctcactgcaacgtccacctcccaggttcaagtgattctcctgcctcagcctcctgagtagctgagattacaggcacatgccaccatgcccgcctaatttgtgtatttttagtggggatagggtttcaccatgttggccaggctactctcaaacgcctgacctgaagtgatccacctgcctcagcctcccagagtgctacgattacaggtgtgagccaccgcgcccggcccctaggatgattttcataagctttcttttaaataattcagctaataaaaagaattgaatcctgatgcctcaagctaaccaatattctgtcttctattattatccattcccacttattgtcatggacaaatggagggagagaaaatcagtttgagcaagagatgtctgcctttacataattatcttctccctccctcacactgactttgagaggataagtgctgtgtgcctactttgctgacaaaaatgcttaaggtgtgagcacactgggagcagggaaggagaaaggggaggcggtcattcatgagacacatgcttagctgactctatctttgccttctctctcatcagggaaaagttggcactcagaaacaaagaactccttgatgcaggatagggatgctgcatctgctcgggcctggcctaaaatgcacacagtcaatggttatgtaaacaggtctctgccaggtatgtacacacctgctcaacaatcctcagggtcttccaaattcagcaccagagttctgtacttcagttcacaaacagctcggcatctcagaggatatagcccactgaatacttgaagatctctggcctctggggatcttaatgtatagtaggcaattcctcttttggtcacctgaaaatgaaggcttacccatgtacatacagcccacagtcagatttttctttccttttcttaaatgtgagtgggcaaccaaggatgaacagacatttaaaaagaacctaaaatatggaagggatatgcaaagatgaacaaagaaaataataatcccagaataaaaaaagctatggctcagaacagaactcatcggaagctcttacttctattttcataaagattcaagaagatactgcatcaataaagtaacaataagatgccttccagttttaaaataggggcatagaggcaggctggctttactccctctcacagaaaaccaaaaccaaacatacagcaccaatatctacaccaacaacaacccagagctcacatgtgaggatgagacagttcccggagccacagagaagtgaaaaaactttgagaatcagacttccacatccatgactctccttcctcctattctgcccagcaccaagtgtatggaaaatctcccctcaactcatggtttctacactggaaaaagtgacattgaggtgttcaaccagcttctccaccttcttgggttccctggggggagatttgtccttgccttaacccacagaaaacatcatgactgtctgaaggcagaaatatcccagagtacaggcagagacaaatgagggaggaaggactaccatccccagccctggaaattctgctctataatttggccaaagacatgcaaattcagaatggccgtgcagcagcaccatgctgtagcaggtttatcctacaggtcaccttggcatgaatcactagctggccttccaacactgctatgataatccctttgggacctcacccacttgggacaggcagggctctgaccacttactggaacacctgtaatcccagcacttgagctcagcacaataacaataggagatggctactaccgttaattttatgcagttacgatttaatactggatctttacgtttgtttacatttgtcccaactggcaccttcatcacctccaccctccccaccccagactatggtaaccacgattctactctctattttcacaagatccactcttttagctcccacatgtgagtgagaacatgtggtattgccctgcagtgtcacctatgttgatgcaaatgaaaatattcttttttatggccaaatagtattccattatgtatatataccactgaactgtacacttaaaaatggtaatgatggcaaattacatatgtatattttacatcaataaaaagaaacttaaaaataaggtaacaataggattctatgaaaaacaatcataacaaaacgtgctcataaaaattataaacacaatggtcaaaatagaaactcaatagaaagtactaagaatagataaaatctttcataaggtcaaacaaaatgtggttgagaatatagttgacccttgaacaatgtgggggttggggtactaaccccctgcacagtcaaaaatccatgtataacttttgactccctccaaattcaagtactaatgacctattgttgatcagaagccttatcaataacataaacaacaaatattttgtgtatgtattatatgctgtatattttcaataaagtaagctagagaaaggaaaatgttatttatacttttctctgcttcttgggagtacttccagcatcactagtggcactttatacgggtcccaagtatccttcaaagtttatggagagatgaaatgcttatgcagagatgattagcatcatgcagagttttcagtggatgcctgcagcactcgagctcagcacaataacaataggagatggctactaccgttaattttatgcagttgcgatttaatactggatctttacgtttgtttacatttgtcccaactgggaatggtgccatgtatggttgtaagtatgtaagtttttataaatttcaactttttataatagatttttgtatattttatggtaataaatgataaaatagtctagtatcaacatgtatatgtatatataagtgtgtatacatatatatatatattttttttttttttttttttgagacggagtcttgctgtcgcccaggctggagtgcagtggcgcaatctcagctcactgcaggctctgccccccggggttcacgccattctcctgcctcagcctcccgagtagctgggactacaggcgcccgccacctcgactggctaattttttgtatttttagtagagacggggtttcattgtgttagccaggatggtctcgatctcctgacctcgtgatccacccgccttggcctcccaaagtatatatatatattttttgagacggagtcttgttctgtcacccaggctggagtgcagtggcacaatctgagctcactgcaacttccccctcttgggttcaagcgattctcctgccccagcctcccaagtagctgggattacaggcatgtgccaccacgcccacctaatttttgtagttttagtagagatggggtttcaccatgtttgccaggccggtcttgaactcctgacctcgtgatctgcccgccttggcctcccaaagtgctgggattataagtgtgagccactgcatccggccatctccatatattttttgcattcataacatacctttttcttaatttttttgatatttttaccctatgtggtccatctgacagttttttcaaattgtcataaatttccaaaaaaatctcactatatttattgaaaaaaaactgcatataagtggactcatgcagttcaaacctgtattgttcaagagtcaactgtgtgttttaaagcagattttaacatcaagaaatgatagaaaaatgataagaattaaaagagataaatattcatattagaattgcccatcaggagcttctgagtagctgaacgcatggaggttcctggagagtggctggccccatgccccttcccacatacccttccttatatatgcatctcttccatctggcgtttataagaaaaggtgctgactgctgaattataaggacactgtggtctactagataaaggttgaggagaggggtttgggcttctattgtcttctttccgggccttcatctcctgcttgtgattaagtagtgcatgctgagtggagcaaagtggtggaataggactcttcagcaataatctcctcacagaaacatcaaggtaacaactcgatgcgtgaaattaccttcagaagagttaagaaaacctgaacccatgagcaagactgtgaagcccttttggactgcaaagacgagtaaaaccatagttgcacataaaggggattggttctttatgactgagaccccacccgcaagccactgcagtaccacaggcggaaagtcaccatggacccacggtttttacaccggaaaactctcccgtatggcctgagtgccctctgtggatctccactaattagtagcagagccagcatgagacttgcgtctaacctgggctcagggcgccctctcgtgctaaaaggaaatacaacagccagtcctttcactttctttttgatatggtctctgttgcctaggttggagtgcagtggtgcgatcatagattactgcagtcttgaactcctggctgggctcacacggtcttcccacctcagcctccagagtgggactacaggtgtgtgccactatgcctggctaaattttcgggttttgtgtgtggggtggggaagattggggtattgctatgttgctcaggctgggtctcgaactcctgacctaaagcaatcctccagcctcagcctcctaaagtgctaggttacaagtatgagccaccacactcagccccactcaatttctaaacgagctcactgaaatagagcagtcacaaacaaacccagactgtgaacatgagaataaatacctaattcttcaatgtgtagacagggatgcacatctgcaaagaataagaatagcctaagaaagacagcctcaacaaatgaacaaaaaatcgtgccagtgactaatcctaaagacatgcaggtgaatgatctggtagacaaagaattcaaaatagctattttaagaaaactcaacaaacttttataaaacacagagaaacaattcagaagtttatcaaagaaatttaacagagaaattgaaggaataaaaaaagtcagaaatcctggaactgaaaagtataataaaaaatgacacatgcaatacaagacatcagcaacagaattgatcaggcagaagaaaggatcagcaagctcaaagacaggttatccaaaaatacaatcaggaggggcttcaggatggttgactagatgcatctagtgttcatcccttccatggagaggaaccaaagtagcaagtagataattatactttgaataggtcatctaagagagaacactggaattcaacagagcagtgacaggaagcattgaaagcaagggaggagagagaaataaggcctgtttgcctgggattggctgggagtctggaacagcttcctaatgtggggaaaaggtaagagacccttagtgttcctcattttcaccaaggactcttgcaatcctagccacaggagagcgccttattccttgacagcacagagactagcatagggagttgcctaaagaccgtgtgaaggcattgcaacagagagctcacgctggattctgcaattctcccaagcagctgcagcacagcaccattttgagaacacagcccacacatcctgccctgctatgatggccgtgacttaggcaggagccctgagcagtgatcctgccccacccagcagaggagtgcccatgcattttcacatattccaagaacaaattccactacctacaaccactgctgctgcaggctgctgtggggccaaaacactagtgaaccttgtgctcccaagctacctgcctacagctactccctgagaaagcaaccccaccttcaccaagagcagggctatagcacagctactgctgcaccccaacctgagcattttgctagtgacctcggtatcaccccacccctgcatagcacaaccagcacctcacacaccaccaaggagcctgagggcaggttcacgtagcccagctctacctgcccccagtacccaagcatatcatccaggggcctagggatcacttagccctgtccaccactggtggcacctgagcacctcctggggtctgaggtcaggcccactcaacctgccactactgccacagttagcactcactgcatgcaccacttgagggtctggagactggccatgcgatccatagcagccacaaccaacgccagcacagaccacttgagattcaggttgtttcattgctatgattgccatcaaccatgccactttgctgcccaggaacttgagaacccacccacccatgtgatccatcaataccacttctggcacccaagtaaaccacttggaggcccacaaatcaacctgcctggacctaaaaccagtgcaatcatatgccaccatggtacaccaaagacaagcacactcagcccactgctgccaccattggggcctgaagacaggcctacctggcatcccacttctcagaaaaacttcaccacagcctccactaataaccacaccctaagccactgagaaaatcacaaatatcactgatgctgtttagaatcttatacagaggctactacattcaccgagaatcaaaaccgaagtgctctacccaagcaacaccacagatacatcttcaggaaaaagttctttcctacaaaagcaaattttaaaaattggaaaaagtgattattacaccagatgtgcagatatcaatgtaaggacacaggaaacatgaaaaatcaaggaactatgacactccaaaggagcacaataattctgtagcaagagatccaaataaaaaaaatttaagatgggtacaaaaaaatagaaagaatgaataagacctgctatttgatagcacaacatggtgactatagttaataataacttaattgtacattctaaaataaagagtgtaattggattgttaataactcaaaggataagtgcttgagggtatacatacctcattctccatgatgtgtttgtttcacatcacatgcctgtatcaaaacatctcatgtgttccataaatatatacacctactatgtatccacaaaataaaaaaatcatagtttacaagcaaaacagtatatgtgaccattggtttttaagtaaactggccaacatctctttaaaaatttatgaaatcctggaaaaataattccaaattttgatactaaataaactcagtgagatacaagagaattctgaaaaaaatacaaagaacacagaaaaacaattgaggctatgaaagagaaatttacccaagagatagatatcaaaaaagaaccaaacaaaaattctggaaccaaagaattcattgaatgaaatacaaaatagatttgaaaggttcaacaatagaccggaccaagcagaagagtatcagaactgaaatacagatcttttgaaataacccaatcagacaaaaataaagaaaaaagaattttaaaaaatgagcaaagatttcatgacatattaggcactataaagtgaccaaatatttgaatcttcagtgtcccagaaggcaaagagaaaatgaagaggttagaaagcctatttaatgaaatattagatgaaaaatttccaagtctaccaagagatttagacatctagataaagaaggctcaaaaatacccaaataaatacaatgcaaaaaggtcttctccagggcacattatagtcaaactatcaaaagtcaaagaaaaaaatttaaaaatagcaagagaaaagcatatagtcacctgtaaaggagccgctatcagactaactgtgaatttctcagcagaaactttacaagccaggagagaatgagagagagagaaaaaaaaaaaaaaacacctgccagccaaggatactgtacacagcaaaattatccttcataaatgaaagagagagaaaaatattttcagacaaaaaaaaactgaggaaattcattgcaacctgatctgctttacaggaaatgctaaagggagtttttcaaactgaaagaaaaaggtcctaatgtgtaacatgaaaacatctgaaggtataaaacccacaggtaaaagtaagtatcccgacaaattcagaattctctaacatggtaattgtagaacataaatcacttatatccttagtaggaagattaaaaaacaaaacagataaaaataattaccataacctgttaaagaataagcaatataaaaagatgtaaatgatgacatcaaaaacacaaaatttgggagtcgattttttaaaaaattttcttgcaatcaaaattaagttgttatcagttcaaactaacttgttataactataaggtattctgtgtaagcctcatggtaattacaaagcaaaaatttttataatagatacactaaaaataaaaagcaagggattaaaacatactgatagaagaatcacttaaccacaagggaagagattaagagaggaagaaaggaacaaaggatctacacaacaactagaaaacaagtaaaaatatggcactaccaagttcttacctatcaaaaattaccttgaatacaaatgggttaaattctccaactaaaagacatagagtgtttggttttttgttcttgcgatagtttactgagaatgatgatttccaatttcctccatgtccctacaaaggacatgaactcatcattttttatggctgcatagtattccatggtgtatatgtgccacattttcttaatccagtctatcattgttggacatttggaccgcatattctcactcataggtgggaattgaacaatgagatcacatggacacaggaaggggaatatcacactctgggaactgttgtggggtggggggaagggggagggatagcattaggagatatacctaatgctagatgacgagttagtgggtgcagtgcaccagcatggcacatgtatacatatgtaactaacctgcacaatgtgcacatgtaccctaaaacttaaagtataataaaaataaaaataaaaaaatttaaaaaaagacatagggtggctgaatgaatttttttttaaaaaaagatctaactacatactgcctaagagaaagactttacctgtaaggacacacatagactgaaagcgaagggatagaaacagatattccatgcacatgtaaacaaaaagaaagcaggaatagctatacttatatctgataaaatagacttcaagtcaaaaactataaaaagagacaaacagccagacgtggtggctcatgcctgtaatttcagcactttgggaggctgaggcgggtggatcacctgaagtcagaagttcgagaccagcctggccaaatggcgaaactccatctctactaaaaatacaaaaattaaccaagcatggtggcaggcgcctgtagtcccagctactcgggaggctgaggcaggagaatggcatgaacccgggaggcggagcttgcagtgagccgacattgcaccgctgcactccagcctgggcacacagcgagaatctgtcaaaaaaaaattgacaaacaaggccattatataatagtaaagaagttaatacaacaggagaatgtaacaagcataaatatatatacacccaacattggagcacctaaatatattaatgtttgatctttgtattttctagtctcattaaaagtaagggcaaaaactacaattacttttgcaccaacctaatataaagcaaacattaatagaccaagggggaaatgaagacagcaatgaaataatagtagaaaactttaacaccccactttcaccaatggacagatcatccagacaaaatatcaacaaagaaacactggacttgaactgcactgtagaccaaatagagcaaacagacatttacggaacattccatccaacagctacacagttcacattcttctcaactgcacatggaacattctccaggagattatacattaggccacaaagcaagtcttaactaacttttttaaaatgaagtatttttttcctgccaataatggaataaaactataaatcaacaacaggaggaacaactgtacaaatacatggaaattaaagaacatgcccctaaacaaacaatgggtcaatgaagaaattaaaggagaagttaaaaaatttcttgaaacaaatgaaaatggaaacataacatgccaaaacttatgggatacagcaaaagtagtccttaaagaaaagtttatagcaataaatgcctacatcaaaaaaaaatctcaaataaacaacctaatgatgcatctcatggaactagaaaaacaagaacaaacaaaaccccaaattattagaagaaatgaatgaatacagatgagagcacaaataatcaaaatagaaactaaaaaatacaaaagatcagtataatgagttagttagttctttgaaaagataaaaaaaagtcaataaacttttagccagactaagtgataataaagaagaaaaacagaaataaatcagacatgaaaaaggagacattacaactgataacacagaaatacaaagaattataagaaactactatgaacaactataagccaacaaattgaaaagcctagaagaaatggataaattcctggacacatacaacctaccaaggttgaatcaagaaaaaatggaaattttgaacaaatcaacaatgagcaacaagattgaagcaaaaatacaaagtctcccatcaaagaaaagttcagtacccaatggcttcactgctgaattctaccaaacatctaaagaactaataccaattcttcacaaactattcaaaaaattgaaaaggaagaaactcttccaaaattattttaggaggataatgatcattatcctgatcccaaaaccagacaaaagcacaataacaacaaacaactacaggccaatatcctcaacaaaatactagaaatagaattcaacagcacattaaaagatcatttaccatgatcaggtgggatttatcccagtgatgtaaggatggtttaacatatgcaaattaagaatgaaggacaaaaattatattatcattttaatagacacagtaaaggcatttgacaaaattcaatatcccttcatgataaaaactctcaacaaagtatagaaggagcatacctatatgataaacctacaaacaagatgaaactgagtggggaaaagttgaaagcttttcctttaagaactggaataagacaagcatatccaccctcaccacttctattcaacacagtactggaagtcctagccagagcaattaggcaagacatccaaattggaaagaaggaagtcaaattgtccctgtttggccaggctcaatggcttatgcctgtaatcccagaactttgggaggccaaggcgggcagatcacttgatgtccagagttcgagaccagcctggcaatatggtgaaaccccatctctactaaaaatacacacacacacacacacacacacacatgctagccagacatggtggtgcgctcctgtagtcccagctactcgagaggctgaagcaggagaatcactagaaccccagaggcggagcttgtggtgagccaagatcgcaccactgcactgcagcctgggcaacagagtgaaacactgtctcgaaacaaaaacaaaaacaaacaaaacaaattgtccctgtttgcagaagacatgatcttatatatagaaaactgccaaaactacaccaaaaaactgttagagctagtaaatgaatgtagtaaacttgtagtctacaaaatcaacatacaataattgatagcatgtctatatgccaacagtgaacaatctgaaaaagcaatcaagaaagcaatcacgtttacaatagctacaaaaaatgtccagaaataaattaaccaaggaagtgaaagatctctataatgaaaactataaaatattgatgaaagaaattgaataagacacaaataaatggaaagatatttcatgttcatggattgaagaattaatattattaaagccaaagcaatctacagattcaatgcaattcctatcaaaattccaatgtcattcttcacagaaatagaaaaacaatcctaagatttgtgtggaaccacaaaaaatcccaaagagccaaagaagtcttgagcaaaaagaataaacctggaggcatcacactacctgatttcaaattatactacaaagttatagtaaccaaaacagcattgtgttgacataaaaacagacatatagaccaatagaacaaaatagagagcccagaaatacacccaaacatttaaagccaactgattttctacgaagttggcaagaatacatgatgggtaaagaacagtcttttcaataaatggtgctgggaaaactggatatccatatgcaaaagaatgaacctagaccccctatctctcaccacgtatgaaagtcaaataggccaggcacagtggctcatgcctgtaatcccagcactttgggaggccaaggcaggcagatcacttggggtcaggagtttgagaccggcctggccaacatggtgaaaccccgtctttactaaaaatacaaaattagccaggtgtggtggcacacctgtagtcccagcaacttgggaggctgaggcaggagaatcacttgaaccccagaggtggaggctgcagtgagcctagatcgtgctattgcactccagcctgggcaacagagtgagactctgtctcaaaaaaaaaaaaaaaaaaaaaaaaaagaaagacagaaagaaaagaaaagaacaatagattaaggaattaaatttaagacctgaaactctgaaattattagaagaaaacatagtgtaagcatttcatgacatcaatttgggcaagaatttgttagacaagacctcaaaatcatgagtaacaaaagcaaaaataaagaaattggattacatcaaactagaaagcttctgcacagcaaaggaaacaatcaacagagtgaagagacaacctatagaatgggagaaaatatttgcagattatacatctgacaagggattgatatctagaatatataaggaactcaaacaactcaatagcaaaagtccaaataatcctattaaaaatgaacaaaagacctgaatagacatttctccaaaagagacctacaaatggccaacaggtatatgaaaaatgctcaacatcactaaccatcaggaaaattaaaatcaaaactacaatgagatatcacttacccctgttagaatgactattataaaaaagacaaaataacaagtgctagcaaggatgtggagacaaagaaacccttatacactgttggtgggaatataaattagttaagccattagagataatggtatagagatgcctcaaaaattaaaaatagatctatcatattttctagcaatcccactactgggtatataccaaaaagaaatgaaatcagcatgttgaagaaacatctgcatccccatgtttatgacagcattattcacaatagtcaagatataaaatcaacttaaatgcccatcaatggatgaatggataaagaaactgtgatatagatacacaatggaatactattcatccatttaaaaaagatgaaatcctgtcattttcaacaacgtggatgagcctggaggacattatgttaagtgaaataagccaggcagagaaagacaaatactccatgatctcagtcctatgtacaatctttaaaatttgatctcatagtagttgagattagtgattctaggaagataagggggaagtgggagatggggagagattggtcaatgggtacaatgttacaggtagatagaaggaataagttctggtactctattgcacagtagggtgacaatagccaacaataatatattgtatatttcaaatagaagagaggattttgaatggtctcacaacaaagaaatgacaaacatttaaggtgatggatatgataattaccctgatttgaataattacacaatgtatacatgtattgaaacatcacattgtacccataaatttgtagaattatttatgtgtcaataaaaagtaatacagttaaaaaaataaaattgcccattaggataaataaaaagacccacacacaaaattatcattgtggcatttcagagcacagagagaagatacttaaagcttcttctgagaggaacaggacgcatacaaaagaatgggaattagactggcgatataattaagcaatattgtaaaagatctaagggaaaaattatttggaacctagaatttttagtcaaactatgaatcaattttgggggaagaaaaaagacattttcatatatagagggccttaatagtcactgaatgtgtactatagtaaaaccagaaactacataaaagaggaatttgggagattcagcaacccaagagaataatgaagtatgagggggatgttttctccttagttcttttccgtatttttcaataatttgataataaacatgcataattttataattaaaaaggaaattaattttgacaacatgcaagttcctgttctcacataccttatagtggagggacagattgtagtcaaataagcataataatacatgcaaaattacaaactgagcattactctgaaggaaaattacataattctatgtaagcctataatacaggaatctgacctagactggggaatcagagaaggcttccctaagcaagtaccccttgaacttagctttgaaactgggaaaatgaggcaatgtgagatgaagctgttagaggtattaggaatcaaacctattggggccttctagtccttagtagagagtctggactttattctatgtggaatgacagcctccagtgggttttaggctggcggatactacaatcagatctggaatgcagaaatagtacaccagtttctttgtgggtaaaagtcttagaggggagaatatgaccaactgtagggagacctgtaaaaaaagtttatcagtagctcagacgagataatggtaacttggattaagatagtggtagtagtaacagtgaaaaactagatacatttgaaagcttttagagccaaaataggaggcagctgtgcccttgttgttaccagtgtgggatctgaacacatgactacttgggttcaaatactgagcaaattaattaacctctctgggcatccgtttcctctcctgcaagacatggatgataatggtttctacattcatagggttgttatgaggaatgaatgaattaaaacttgtaaaatactttggacagtgcttgacataaaacaagtgctcaatacatattagctattattgattatattgccctggtcagtgtcaaactgcatatgggagatgagaatggtaacaaggataactctcacttgcatattcaaatgcaggatgctgccattcactgttataaaaaactctggaagagaatgaagtgatgaaaattgtaaatttggttttgaacatgtgggttttttgagatatctaggtggagatgttgagaaagtgattggctgtatgagcctggagttccagaagaggtcagcaggggagacagaagaaggagcagtctgagaagtaggagaaaaaaacccacagagatgttggcacagaggccaagggaagagagagttttaaaaacgaatgaatggtcaacaggtgcaaataaagactgaaaaatgtccattggatttagcagcatgatggtgattggtgaccttggcaagagctgttggtttgatagtagcccaatgttcttgataaatttgtttacaagtcaaggtagcaataaagtgtctaaagtcaatttgtccattctgtcctagcaagtgttttccatttcagattctctacttcatagccataggtgtcttattcctactttacaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatggtaatatcttggatctttaaaatgaatattataaatatccagtcctacttttaataaaatttactggacaatgtacaggaatatagtgtgttgctgaaggggacattatagagttactgtattagacctcagccaagatcccctagtttccagcttccagtgtaaagtttttaccttgactataaaagggcttgagtattagtaggactcatggatttttagttaaatgtctgtgatggagaaaagatggcttatggatgattgaggtgggaaaatgaggagaatagtatgcccttggtttctcagccttatcccattaattacgctccaatattatggagagaggaactgcaagttgtagctgaagagattttttttttttttggagaaatctagggaaatgggaaaaaaaggcattgtccagattgcaactgtaagggctccactatatcattagtaatgcccagagcagtaaatagcaaatatgacaggctattgtagagcttgacttcagacaccagacagccagaggcactctgtagatacctggcagtagatgagagacacctgtgaaactgagggcaggtcaggagctagtgaattttagaagtaacatgggattgaaaggactatttggtgggaactttggaaagggtcaaaggttctgtgtaagcaaattaggacgatggtaactacagttttaaattattgttaatgtaactttatttgtaactgctagttgtgcaaattcagattgcatcatcatttcaccccaattttccttacttttgtatttattctgctaactcttaatcttggatcaacctaataaccctctttctctacccctctcgtggccattgaaggctcttagtcagtttgtgctgcaataacagtataccacagaatgggtaatttataatggacagaaatttattggctcacatttctgggggctgggaggtccaatatcaagttgcctttttctgcgtcttaacatggtggaaggcattatatgacaaaagggcaaagaaagggtgagagagagcaagaggagggtgagctcactcctgtgataacaaatccactcccatgaacactttccccagataactgcattagtccattcatgagggtggaacgcttatgacctaaacaccttttatatgttcacctctcaataccatcacgatgataattaaatttcaatatgagtttcggaggggacagacattcaaaccatagcaagagttattggagaaaaatgtcggagaggcctaatcttttatatttaatagcatttctttcttcctattactctcatattaaccttctcctcaggttccttggttgacttagaaaagagaattgatcttgccatgcatccaccattttcctccttatgttctattagtgaccttgtttattgtcttctgtagtgattaagaatagaaatctctcttccccatgtgtcacataatatttatggaattttgacaagaccttagtggacaaaatgtgtcatactgaatgagtaacaggaagttgatgcacaaacaacattcttgcaggcacagaggaataggtcatttacttgtatatgatcattgtcaatcaatcattgtccagttggaccccgattcagtttattttttgttttgtttttctccttttcacagattctatccactaattttaatctttatttttcagaaaaaaatgctttatcttattgaacctcagaccaaacactttgtttttcgatgcagactgagttatgtttaaggctacatgaaccccagactagttgtttgctgctcctaaaaccttccctgttcctcataatcaagtaaacaggtctcccttcttagaagtatttgatcttcaaaattgccctgtggtataaatagggcaggaattattattatccattttacaaagcatgaagatgagactgagaatgttgaatacatttgccatagggtttacaactagtcacaggcagacatgctcttaaaatatatatctccttgattttaagttgtatcttgtcatggttttatgaacttggaacatgtcttaaagtttatatctacactaacatttttcccaataagctgttattaaatcaatgatttgtggcaagaagggatagtgatgtggaaagggggggtacttaggggagagcctggaaggcctaataagagagaaagaagtcataaaagttaaggcaagtgatatggtttggatatttatcttcactgaaatctcatgttgaattgtaatttccaatgctggaggtggggtctggtggcagatgtttggatcatgggggtgaatccctcatggcttgatgctgtcttcatgatatttggtcattcagaagtgtgtggcaacttgcactctctgtcttgctcctgctttcaccatgtgacatgtctcctcccccttcacctacccccatgattgtaagcttcctgagacctccctgaagccaagcagatgccagcaccatgcttcccatatagcctgcagaaacatgagccaattcaatctcttttctttataaattacctagtctctggtatagaacagcctaatatagcaagacactctgacattgtttggtttgtctgactccagatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacaggtaagcactttttgactattggtactctctcttccccatactcaaaaagttcttaccagttattcaaaccaacaaatcctgaagccatgtttaaggttaggtacaggtatggaatcaaatggcaagggtattaacatttggaaactaacatagctgagcatcagagaagcttgtatttttctcactccttgccttgattgaatcatataagctgttttagagttggatttgagcctacctagaatttttcttcccaacctctcatctttttttctcttatacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttggtaagttgaagaaaagatttaaggtcaggtaagaagaaaaagtctggagagttttgagtttctaaaatacctcataattcagccttgtctccaatggacatgatcttttaaaagctataaatgttacacaaataatagctgattgtatgtatttaaagtttgagtatatagaataaaaatttaatgtcacccactaaactcgacactcctttgaaatactgcttagactttgatacatatccttccagatctttctccattaattatgtcatataggagtcagcagactatggcctgtgaaccaaatttggcttgtggcctgcttttgaacagtccatgagcttagatgagattttacatttttaaaatattgcaaagaaaagaaaggaggatgggaggaaggggaggagaaggcggaggagcaagagaatatgtgacagaggctagatagggctcacaaattttagagtacttactatccagccttttccaaaaaatgcttgcttgctcctgatctaggatattaagaatgagtatggtgtaagtaacagaatactcaatggacagtggtttaaataaataagggtttattttcttcacaagaaatttgaagattggtcgttggttccataaattcagccgctgaagaatgtcatgaagaacactggtttttagatatggagttttgttagatactgccaaactgactttcagcaattttgtaccaatttatatcccctaccataagtatatgactgcccttttccccacaccattgccaacaacatatattataaaccttcagaaaattttccaatttgatgagcaaaatgtttatatgttgtcttcatttgcatttccctggttagtggtcaaattgtatattgtttcatgtttgttggctatttgtataactccctctgtgaattgcctgcttgtaaattttgtccagttttctatttggtcagtcatcttttgcttatgtatttgtaaaaggtctttatagattatggatattgacacattgttatttatctttcaaatgttttcctcacattgtcacttgtactttaactcctttatgatattttttgtccttcaaagatttttcatctttatatagtcaaaacctcctatcttttatcaatcttttcatttatatgtctctggatctttttcacttatgttttctgcctgagaatgtctttgccacccccaagacactacaaaaatagtctatattttattctcttacttgtatagctttatttttacagtgagcaatctaattgccctggaagttacttttgaatgtagtgcataattcaaatagaaattttcccaaatggcagctgacacaaccaatccttttttcattaatttgaaaatgtcttctttatcatatactaaattgctaaaatctgggatttttaattctccttaactaatctgttaccaccctgttttaatgacttcaactttgtgatatgtttgatatctgtatgacatcttctttcattgtacttcttcaaaatttttattagctattattgtacaatttttcttcataaattttgtgtacgtattttttctatttttcattttttgaagattgtataattttattttttattcattaatttttaaaatgcataatgacacaataattttacatatttatagggtactttttgtgtattttgagttacttttactggctaatttaaaaatagataaacaagagcatgcaataaaatgtaaattttcctccctcttggacttccaaccccatagtctgacagacagtcattgctgtgggtttgtatactcccctccagaagtagtgcatacatgtacaaatgtgtgtgtgtatgtgtgtgtgtgtgtgcatttcacacaaaaacaagagcagtgtaaattggtctgtaccttgatttttaaaaggtaacaatatattttgaattagccaggcatggtggcacatgcctgtagtcccagctactctggaggctgaggcaggagaatcgctcgaatctgggaggcggaggttgcagtgagctgagatcgcaccactgcactccaccctgggcaacagagtgagactctgtctcaaaaaaaaaaaaagtaacaatatattttggatatcatttcatgtcaacatatatagatctaccccattctttgatttattcaggttatactctggataccatgctgaatcctacacttaaacattacctcaaaatggatcaaagataaaatgtaagagctaaaactacaaaattataagaaaacaacaggataaatctttgtgatcttgaattagacaatagtttattggataggacaccaaaaccaacaagcaacaaaagaaaaaccatttgacccagccatcccattactaggtatatacccaaaggaatataaatcatgctgctataaagacacatgcacacgtatgtttattgcggcactactcacaatagcaaagacttggaaccaacccaaatatccaacaatgatagactgattaagaaaatgtggcacatatacaccatggaatactatgcagccataaaaaatgtccccgtttgcagatgacatgattgtatatctagaaaacaccattgtctcagcccaaaatctccttaagctgataagcaacttcagcaaagtctcaggatacaaaatcaatgtgcaaaaatcacaaacattcttatacaccaataacagacagagagccaaatcatgagtgaactcccattcacaattgcttcaaagagaataaaatacctaggaatccaacttacaagggatatgaaggacctcttcaaggagacctacaaaccactgctcaacgaaataaaagaggacacaaacaaatggaagaacattccatgctcatggataggaagaatgactgggttttaagacaagagcagaagtggaagttgcatttttatcctcatatcacacacctcagatctggaggtgggattgatattttcagggttcttcgctgcagcttccatgttattgctcttccattctctctctctctctctctctctctctcgtctctgtctctctctctctctcttgagatagggtctcattctgtcacccaggctggagtgctgtggtgtgatcacagctcactactgcagcctcaacttcctgggctgaagtgatcctcccacctcagcctcccaagtagctggtactataggcatgcaccaccacgcctagctaatttttttattttttgtagagatgaggtctcactgtgttacccaggctggtcttgaagtcctgggctcaaacgatcctcctgcctcagcctcccaaagtgctggcatgagccactgcacctaggcctttgttttcttttaaagctggtgcaatcaggcaataccacctgctacccttgcttaatactgtaatcaactgtcctcttggtcatgcctgctcatgcactgaagattttatctcctgaaacactgtctctttctctattatcagtgaatttaatgcccaaatagtaataaaggctgagaggaagcagtgtcctcaccaggcatctaaatttcaattagtgtgagaaggtgcagagaatacttcctgaagcaattgaaacaatttttaaagaagtggaaaggggcctttagagagaaacctaagtactgtcagccctctacattgtcaactgaagaatcctaagtttgtaaatttggagtggaaagggttgcaggctgggaagtgtagcctctggcagcaaatggaagcaagcactttgaagaaggaaggatgagataagaatttatgctgaatgagttggctaagtatacatatttaacaggttccaggaggagctgtgaatatttatgatggggcacctgcaaccacacatgttacatacattccatgttcactttggggtggagacttaacatttagatgcatgaaaattaggctgtatatgtcaaaagatgaaacagaggacacagaggcagcctctgtaaactggccagagccagtccatggtcagtggtctctcatcaggaagcaatgcttctcggttgttatgataaaactgcacaaagggaggggaatccaccacgtctttagaaaggactggtttatgtttaacccttaagaaagaaagtctaacggcagattagggagggagggaatgtaacaaggcatgcccgatctcccatcccatcatggtcagaaactcagtttttaagccatctctggggtctccttggccgagaaaggggtctcttcagtcgtttggggatgcttaagattttatttttatttttcagtatcactggatttctagtctcatattcaaacaaccattgattgaaagtattcaaaaaacaaccccaaaacaataaaagataataatacaacaataaacaataatacaaagaaacaatacggtaaaacaactatttacatagcatttatgttatattatgtactgtaagaaatctagagacgagttaaagtacatgagaggatgtgcatatgttatatgcaaatactacatcattttgagtaagagacttgagcatcacagattgtggtatctgcaggggtcctggaaccaatcctccatgcatgccaaggaacaatttcatgaaaagaccaaatattttgagttttatctagcctcaaattactataatgtagatagaggccacttttatttatctggagttagaccacagttttcttgttgatcctagtcgttttaggatttgatcttagatctcgcttatactttcagattatatttaagaatcaagcaagcagaccatataacatctaccctcacggaatcactgatgtccgtcctttgtattcaaggagattaccaaaaggtaaatattccctcgatttatagctcttttttacctgtagatacagatgagataaatatcatcaataacaactaaaattatgttggtcctttctccagctgttggccggacctcaagctccagtctaaagttataaaaatcaattataggaatcctcaggtgatgtttcatgtaaattcgtgaagagtcgcctgacatgtttttcctattacctagcggtgatgttcaaatattccacagccaattagattccactgcaattggttccactgcaactactgtaaatgccctaaaatcttgaagctggttcttctggcacttaagataatttttttttctgagtacggttttcagctacattccacacttttggtatctagtgtggtattccacactttgggtaactagtttgatattttcaggattctttgctgcagcttccatgttattgctcttccttgctctctctctctctctctctcaacagggtttcactctcacttttggtatctagtttgatattttcagggttcttcgcatattcatttctaaatagttcacaactccagtttttatttactatattgtttgctgtttaaagatttattttttcttttagtagattggatgttatgtatattctttctattatttaattttggatgaatatttatcaaaataatagatgtgtatgcttaaaactacaaaagggctgcctccctagaggcatccatttttaagaatttctgtttttgatttttggtggttatctctacatctctaaaaagttacttatactgctaactctttgtttttcaactttagacattatatacttactttgttttgtgcttttttccattcaagttgtttcagttttatcagtgttttcagttggattggctatcattagaactttaaaaatatactaaacatcaacttttagtaagatattttccaatcatggattgaaaatatcttttgactccatacttcataaattaaggatattaaaaactgtacccctcacttttcctttccccaaacctttcttttctctactgctgctagccattcctttacttttacaaaactaaacttgataacatttacattttgtgctgtaatttgaaataactcttccttgctttgtctatatattttctctaaagcttaaaaaattaaaaaacagcatttgtattattttagtattttagcaagtttcttttcataaatgttaactgcagaactgggtaatatgctatgattgctctcttttctacagctcaagtgattttactattaagataaaataatatgtggaaggaaaaaagttgatctcatagaagtagagataaaatagtggttactagaggctaaagaggggaaggggagggggaaatagggagacgttggttaatggatgcaaaattccagctagataggaggcataagtcctaatgttctatagcactgtagggtgactgtagtcaacaatgacatctattttcaaatagctagatgagaggatttggaatgttcccaacacaaaggtgtatcctgaagtaagactttgttttcttttattcggaaaagaaatgtaggcttcttcaaccctatttcttaggcctttcagcttcttaatcattctatgtattgcttgctatccaaatcttttattttttttttgagacagcgtctcgctctgtcacccaggctggagtacagtggcacgatcttggctcactgcaacctctgcctcccaggctcaggctatcctcccacttcagcctcctgagtagttgggaccacagacgcacactaccatgcccagctaattttttttattatttttattttttgtagaaatggggtgttaacttgttgcccagactggtgtcgaactcctgagctcaagcgatctgcctgcctcagcctcccaaagtgctggaaccaaatctttttcttcttaaagacattcttgtagtgaatagcattaactacttttcccttgtacatttctattttttgatttcttcttttgtttttctggaagtatattctcaagtaacttctaaatatgtggtacatagagggtgaactttctgaatccttcagtatcacatgatgggcagacagactggttataaaaattttcccgctgggtgcggtggctcacgcctgtaatcccagcactttgggaggccgaggcgggcagatcacttgaggtcaggagttcaagaccagcttggccaacatggtgaaaacccatctctactaaaaatacaaaaaaaatagccgggcattgtggcgtgtgcctgtaatcccagctactcaggaggctgaggcaggagaattgcttgaaactgggaggtgaaggttgcagtgagccaagatcaccccactgcactccagcctgggcaacagagcaagactgcatctcaaaaaaaattccttcccctgttttctaatattcattattgccgataagaattctttatttgcatttctttatggaagaatggcatagtgacagagttctggggagattttgaatgtgtgtcccgaaatttggaggcatacgtggatagttactggtaacctgcttttccatggagaattttgaaggctgtaatgcccataatagtgggcaagaagagagggcaagagtggagcagtttaccttcctgctgtttgacatgagtttattctgtaacaagtgaatactgttgaaagtagctgggctttatcccttttgaagatattctacccaagaaggcagttaggcaggctgaggggatagcagaaccaatagagtcttggatatatcactggaagtaagaagagctgatggggagaggagagttgcagaaggatagctgaaagaaacatctctcatgtcatggaactatgtaatgctgaggtccccatggtaactctaaagaaaccatacatgtgtcctatgaaaagaccagcatttgggcacctcccacacagagaacattgatgaccaaatagtgttgtcaaagatagagcagcaggacctgttaaacaagagtctgtttgccctttcttctattacctaccctccctcacccccagctcctggaaaagggaagagaaggctcagaaatattgaaagaacatactacaccattccctttctttctttctttcttttttttttttttttggagacagagtctcgctctatcccccaggctggagtgcattggcatgatatcggctcaacctctgcctcccaggttcaagcaattctcatgcctcagcctcccaagtagctgggattacaagtgcctgccaccacacctggctaatttttgtatttttagtagagatggcgtttcaccatgttgaccaggctggtctcgaactcctcacctcaacaccattccctttctatggatcctctaaccataggtcaggcataacttactgaggtgaggaagagcttagaatgaatataaaattaaaattttgatttagattgtatcttcaggtatgaaacatacccagaatgagacttaattactaaaatcagttcttgtcctgaggacccattaccctgagggcagatctcagttcttgctccctttcctcacagaagtcagagactacaccttaaaactccaatgccaagctctttggcatatattcaggcctgacactttcacagtcaaccggataatcaattacagctttttactttttaaaaaaattgtttgaatcttaaaattataataggtgcgactttagcttccacttgctcagaaacttcatatgtacatacagatttgtagaacccttgcaacaacaacatgattatcaatatgtggcttgttgtactctaattgagctatttatggttttgcttgtgggtaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccaggtgagttcttgcctttccaagtgctgggtttcattctcagtgtatgtccccttataacctgaagaaaatataatggtttgcaatataggtcagtaaaagaaatgagcttagcttttactaaatttgagtttcacgtagtaaacgtgcctgctggatggataggccatagaatgtaggccctagatttttcctatagtactcattcccagtctgggatttagctctctctagctgatcctccccatttttatatgtccaattaccacctattttcagatgacccacagatttatatctacagcctagatttcttccatggacatctcattatgggtgactcaaaagtacctcaaaattaacatgtctgcagcatgtagcactgttgcaggaagtcagggaccccgaacagagggactggctgaagccacggcagaagaacataaattgtgaagatttcgtggacatttattagttccccaaattaatacttttataatttcttacgcctgtctttactgcgatctctgaacataaattgtgaagatttcatggacatttatcacttccccaaccaatactcttataatttcctatgcctgtctttactttaatctcttaatcctgtcatcttcataagctgaggatgtatgttgcctcaagaccctgtgatgattgcgttatctgcacaaattgtttgtaaagcttgtgtgtttgaacaatatgaaatctgggcaccttgaaaagaacaggataacagcgatttccagggaacaagggagataaccataaagtctgactgcctgcagggccaggcagaacagagtcatatttctcttcttgcaaaagcgaataggagaaatatcactgaattctttttctcagcaaggaacagccctgggaaaagaatgcattcccagggggaggcctctaaaatggccgctctgggagtgtttatcttatgcagttgaagataagggataaaatatgccctggtctcctgcagtgcccccaggcttgctaggattaggaaattccagcctggtgaattctagtcagaccagttctctgctcttgaaccctgtttcctgttaagatgtttatcaatgacaatgcatgcacagcaggacatggaacctcattagtaattctaatttcgccctaccttgtgatcttgctctgtccctatttgccttgtgatattttattgcctttgaatcatgtgatctttgtgacccacaccctattcgtacactccctcccctttgaaaatcactaataaaaacttgctggttttgcggcttgggggcatcacagaacctgccgacatgtgatgtcacccctggagacccagctgtaaaatttctctcttttgtactctttctctttatttcccagaccggccgacacttaggtaaaatagaaaagaacctatgttgaaatattgggggctagttcccacaatatagcacagtgcatctcacttagtaagagcttaataggctacgtgcggtggctcacgcctgtaatctcagcactttgggaggccgagacaggaggattgcttgagctcaggatttcaagaccatcctgggcaaaatagtaagaccttgtctacaaaaaaaaaaaaaaaaaaaaaaaattagctgggcatggtggtgtgtgcctgtagtcccacctactcaggaggctgaggtgggaagatagcttgagcccaggaggtcgaggctgcagtgagcctggatgacaaagcgacaccctgtctcaaaaaaaaaaaaaaaaaaaaaaaaaaaagcttaataaatacttttgggcaaaacatagggaaagatataaaatatttcaaaatatggctagaatttggaccatttctactgctttaaaaaataaagctaaattctctgaacaagaaaagcttagttcttcacaaaaactcattgctcggccccagaataactcagtgccatattgctgaggcttgactacatgtccatttgattatatttatgatacataagatccctactagtctgaaaacatttcatatgtttagagagtaaagtatatgaactttggtgccaataaaacacatggcacataaactcagagaagtataaattttgccaagtacttgtcctgaccgatttttcctaactatagttttttcgtcacttttgggaagagaactgaaatattattctatattctccaatctcctctcttcagtattttggtttatatagctataggttataaaaaatgaggtttatacatattagtgaggtttacatatgaaatcttagcagatccaattagcaagcgactaattcataaatctggttcatatacaaaatgctcttctgaaaaaaatttgaatgttttaaacagaaaatttaaggtattagtgttgtttgacatttttgtggttcaccttatctttcttatttgatttctgtttttctatttttaattttttatagccttgtggaaggtcagttgctagatggaagtttaggaaagtcagtatctcatttgacttaactaacttaagaaaggcactgaataaccacttggttctttaaggagttaaatcttctaatctgaacatgaagagaataaggctacagactgtaccaaataaatcagctagcatatggccttgggtgcagaaaaaactaagttcagtgggatcagtcaccctcttgtcctggggacacatttgttgtaagcatatactcactgctcatagcacccaccctcaactcccaagccctggtacatgcctaagaggaaatggaattaaaccaatggattagatatatcacatgcatgccatcgctttcatcatagactgctagctcctacctgacaacatcagtagcatttctttacccctttcaatatatgtaattaacagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagtgagtaaagcagcacttaagtccagtgggtggtgaataaagaaaaattgatgtaatcaaagtgatgtccagataatgaatgaattgtatgtgcacataaatttaacaattatgttacctataaatgtataatttttactcaaacacacgtgatcatataacccatattttaaaaatccagtcaccattttttcctttcaatatttacttgatttccctctcccttttaattccctatctccttctatattacatcttttcaccaaccattccatgcccaggtaacatattttaagacatattttctctataattatataatcatatataaacacatacatacattgtattagtcttctagtgctgccataacaaagtactgcagactgggtggcttaaccagcagatatctattgtcttacaactctggaggcttgagatcaggatgtgggcaacgttggtttcttctgaggcttctctccttgtcttgtagatggctttctcccttgtcttcacatggtttctcctttatatatctttgtcctaatctcctcttctaataaagataccagtattgttgggctagggcccaccgtaatgaccttattttaactaactacctatttaaaaacactatctccaggtatagtcacatgctgaggtactggggtttaggactgcaaggtataaatttgggatgggggaacacaattcagcccattgcatacatacacatgtgtatatatttatatataccacaaatctgaatggtcaaaaatatggtaaaaaattccaattgcactatcctacagggaaatgcgaaatagaataacaataggatagcactttatacccatcaaactgccaaaattataattactagtgggcttgtggataaaagagtgttctcatgctatattagtggataagtagtatagtcttttcaaaaccaatatatgccttttgaaattctgattattaagatgtttaagatggagtgagccacatttccctgtgtgtcccactggatgcaactaaaaatcctgaacaggccgggcacagtggctcacgcctgtaatcccagcactttgggaggccgaggcaggcggatcacgaggtcaggagatcgagaccatcctggctaacatagtgaaaccccgtctctactaaaaatacaaaaaattagccgggcatggtggcggccgcctgtagtcccagctactcaggaggctgaggcaggagaatggcgtgaacccggaaggcggagactgcagtgagccaagatcgtgccactgcactccaggccggcgacagagtgagactccgtttcaaaaaaaaaaaaaaaaaatcctgaacgaaatgcatgggaaccttgaaaagttataatgtgagttatactcacctaccagaatgtggcatatgttacaattctatgcccctcctctcaaagctttagccctttaactttgggttgagcctcatatttagcttgaatttctagtaatagtgatatattattctccagagttaaagtcctttactatccattattctaaaaattttaaggttgtttagtcctttgagttgcatttttattttttacatagttcagggtattgctttccttctgaaggattcagatttcacatttgtgcaagagtctaatgcttagtatttaattctagtggcacagagctttttcttttctccctcttctctccagcctcatggctttggtttagaattccttcagcctgatagaatattgtattttataatttccttattgtgctatttactagatatttgttcttctatttttttctattcataatttctccctttcccaccacatctttttccaagtaggatgtgcacttgccacagtatctggacagttaaactgtctcattttcttggagacggtgatgaaaactagagagatatagtgacataagcagagccagaaaacaatttcactgaagatgatatatattttttttcctctgggatttctaatatagcttttggtggagataagagtctggaattgagaaagaagagattggaattgagaaaaagagtctgagaaagcacagggagagacacaaaggcagagaccaagagacacaggggaaggatcttcagaggaagagtccagggagaaagatgctaagacagagggataagaaaagaagaaaaaaaaggaccaggaggagagagacccaaaccataaatcactcctatttccattagcagtaaaattgataatctattttcatacaatgaaataccatgtgacaatgaagattcacaaaaataaagctatacacaacaatatgaataagtatcacaaagacaatttttagtaaaatggtaagtgtcaaaagaatatatacagtattatattatttacataaagttcaaaaatgggcaaaattaacttatatagtttagggatacagaggaagaaaagtataaaggttagtaaggacatgattataataaaagacaagatagtggctacctcttagaaagagttcatttgagaataaacacatgtgttttgtggggatagcagcaatattgtatttcatgacctagatgtttgttttataattttgtgttttaaaaaattgtaggatttatgatttatttcgtagatggatcctacaaatgatagggaaattgcagtaggaatgaagaggaaggaacatgtacaggatttgtttagaagatagaaggcacatgattttgtaaataattagctatgtttggtaaaggactaagaggattcaaagatgattaccaaatttctgatatgggtaactagaagaagagtgagacaaaatggaagaaagtgtatttaaagaaatgatagcaaaaactttccaaatctggagaaagatgtaaatatccacgtacaagaagctcaaagatctctagtcagattagattcaaacaagactatatgaagacacgttacaatcaaactgtcaaatatcaaagacaaagagagaatcctgaaagcaacaacaaaaaagaagcaaaccacatacaaggaaattccaataaggcagaaactttacaggtcagaagagggtgggatgatatattccgagtactgggaaaactttacctagaaaatgtttccttcagaaatgcagagagataaagactttgccacacaattccagttagacaagagaaataaattaaagacatctattgtacactatggtgactacagttaataaattacccattccaatatatacatatataaacattgtgatgtacatcataatatattctatttttccctgtcaattaaaaaataaatttaaaaagattggatagagaagaatcagccattctagtaattaagcctgaggaagcttacattccagtgatttcagataaccattatgcaagttaaggaataaactggataggatgatattaaaaaaacaaaaccaccaatgagatacaccagaatggctaaaattaaaaaggctgtccataccaagtattggtaaagatgtagagtaatgagaactctcataaatttctggtcaggaaatccaaacatcgaaagccaaacatcggcataccctattgactcaggaaatccactcctagtatacacctgttatgtcctgaatcatgtcccctagaattaatatgctgaagccctaacactagtatttcagaatgtgactgtatttggagatagggtctttaaggggtttattaagttaaaatgaggttgttacaatgggccctaatccaatatgactagtgtccttataagaagaggaaatgtgggccaggcacagtggctcacgcctgtaatcccagcattttgggaggccaaggcgggcggatcacgaggtcaagagatcgagaccatcctggccaacatggtgaaaccccatctctactgaaaatacaaaaattagctggacatggtggcgagctcctgtagtcccagctactcgggagactgaggcagaagattgcttgaacccaggaggtggaggttgcagtgagcagagatcacgccactgcactccagactggcagacagaccgagactccatttgaaaaaaaaaaagaagaggaaatgtgtacacacagagacaccagggatgcatattcacagaggaaagaccaagccaaggagaggtgtcagtaaaaaccaaacctgccaataccttgatcttggaattttagtgttcaaaactgtgagaaaacacattcctgttatttacacctcccagtctgtggtatattgttatggcaaccctagccactagtacagcacccaaaagtagtgtgtacatatttcacaaaagacatgtaactatttaatccatgtggagtgtcaaaaggcaaaaatacaacaaatgtattttaaagattgtaattggcttttatacatgattctagaatcagatagccctcagaaccaaatacagaacagcagccagcaacatagtatggatagaaattggaagtgaggtttagagacagcttaattgattacagttgggcatttttgccttatttgaagctgttagtcgcctgcaattgatggaagttcagctgctataatcggctgagactgagctgtttgttataaaagcatattcctaaattaggctttcagttagttcatcaactaagccaggctgcaactttgttgtgcaaggactcaagtgcaaaggtacccttaggcaaaattcagattaatttaaaaggactttacttttgttagttatgtgaaatgaagtggaatctattttttccaagtggatagtcatattttctattatcatttaccaactagctgatttttttcctgtactggttggagatgctgcctttattatatattaagtttcaacttattatatattaagtttccgcttacatcttgtcagtttctggactccatattttgtttgatatatttatctattctgcattaagactgcatttttaattataatagctttataatatctcaatgttgtataggaaaaaaacttcaattattaattagttatactaagccaatgtctaagtattgcttagtggtttgtgggcaaccatcttacacagtacctagtaacagagtagacaagtgtttattgaatggatggatgaatggatgtgtggaagaggctttcagaaacaattcccttcatagactaaggccaatgttacttttgcttagctctttagtttgaaataatttaaaatgtacagaaaagttacaagaataatacatggaacttgcacacaccctttacccagattcacaaatgtttaacattttgcaattttgtttttcattttcttttctttatatacacacttctgttacttattttctatttgaaaattagttgcagacatcacatccctttacctctcaatactttagtacacatttcctgtgaataaagatatcttttacataacagacacttcaaattgataaagcacatttccataatttacaactggtattccagttgtatcaaccaatgctgtcatttatagcattttcttctttgaagtacagggatctagtacaagtaactacttgtcctgcttctttcatttccttgaatctggaccttcatcagatggtaactttaagcacccaaaggtttttttctggtttctcctctgtgtagtttaagaccatgcaaacatcttgctactcatcaaaatgccccccatataacatccaaattaatctttatcatgatggtttatgactgtctcctcacattgggattggggcccaactgattattaacaatctacttttttggaagatataatatctcttcctgggaataagataatgggcataacatataataattcctaattgtatcatgacaatcacaatccaaaatactaaatctgtgatgtgtctaaatctcttttccccattgtttttgcaggcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggttagttattatatttttcttgtaccaacagctgtgaatgcttcactagccattcgtatgctcttttgcccactagctcacatgctgtcatttatagcattttcttccttgaggtacagggatctagtttctcctctgagtagttattattttcacccttgcaactaataaacagtttgaaggatcacgtagtagttctatttttagttttttgaggaacctccttactcttttccacagtatttgtacttatttacactcccaccaacagtgtacaagcattccccttttgccacatcctcaccagcattttttaattattttgtctttttgataaaagccatttaactggagtgaaatatctcattgtgcttttggtttgcatttctctggtaattagtgatgttgagcagtttttcatatacttgttggccatttgtatgtcttctttttttttttttttttttttttttcagacggagtctcgctctgtagcccaggctggagtgcggtggcacgatctcggctcactgcaagctccgccacccgggttcacgccattctcctgcctcagcctcccgagtagctgggactacaggtgcccgccaccacacccagctaattttttgtatttttagtagagacagggtttcaccgtgttagccaggatggtctcgatttcctgacctcgtgatccacccgcctcggcctcccaaagtgctgggattacaggcgtgagccaccgtgcccagcctgaatgtcttcttttgagaaatgtctattcagatctttgtccatttttaatagggttctttgttttttttgctattgactagagtttcttatatattctggttattaatgccctctcagttgtatagtttgcaaatatttcatcccatcctataaattgtctcttcactttgttaattgtttcctttgctgtccagaagctttatggcttgatataatcccatttgtctacttttgctttagtcccctgtgcttttgaggtcttacctgcaaaatctttcccagaccaatgtcctggcgcattcccccaatgttttcttccagtagtttcatactttcaggttgtatattttagtctctaatccattttgatttgatttttgtatatagtgagagataggggtatagtttcattcttctgcatgtggatatccagttttcccacaccatttattgaagagactattctttcaccagtgcgtgttcttggcactttgtcaaaggtgagttggctataaatgtgtggatttatttctgggttttctgtcgtgttccactggcatatatttctggttttatgccagtaccgtgctgtttttgttactacagctttgtagtatagtttcaagtcaagtagtgtcatgcctccagctttgttcattttgctccagattatttagctgtttggagtcttttgtggttccacacaaattttaagattcttttttctatttctgtgaaaaacttcactggcatttggataggtattacattaaatctggtagcattgatattttaacaatattagtttttccagcccattaaaatgggatagataccttttcagttttttgtgtgttcttcaattccctttatcagtattttagttttcattatagagatatctcagctctttggtttaatttattccaatatatttatttttattatagctattgtaaatgatttttaaaaaatttctttttaggttgttagctcttggtatatagaaatgctactgatttttgcatgttggttttgtatcctgcaactttactgaatttgtttatcagttctaatagttttttgatggagtctttagttttttgtgaaatataagattatgtcatctataaacaaggagaatttgacttcttcctttccaatttgggtaccctttatttctttctcttgcttacttgttctggcttggacttccaggactacattttatagaattggtgaaagtgggcatccttatcttgtttcagatcttaaaggaaaggcttttggttttccacatttggtatgatattagccgtagtttgtcatatatggcatttattgttttgaggtaagctttctatacccagtttgtttagagttttctcatgaagggatgttgaatttaatctttttggcatcaattgaaatgatcatttgtttttgtccttcattctgttgatatgatgtatcacattgattcatttccatatgttgaaccatccttgcatccctgggatgaatcccccttgatcatgatgaatgatcttttactgtgttgttgaatttggtttgctagtagttcgttgaggatttttgcatcaatgttcatcagagatattggcctgtagtttctttttgtgtatgtgtgtgtctttgtctggtttggtttcagggtaatactggccttgtggaatcagtttggaagtatttttcccccttgatttttgggatagtttgtgaagagctggtattagttctttttttttattattatacattaagttttagggtacatgtgcacaatgtgcaggttagttacatatgtatacatgtgccatgctggtgtgctgtacccattaactcgtcatttagcattaggtatatcgcctaatgctatccctctccccttcccccaccccacaacagtccccagagtgtgatgttccccttcctgtgtccatgtgttctcattgttcaattcccacctatgagtgagaatatgcagtgtttggttttttgttcttgcgatcgtttactgagaatgatgatttccaatttcatccatgtccctacaaaggacatgaactcatcatttttatggcggcatagtattccatggtgtatatgtgccacattttcttactccagtctatcattgttggacatttgggttggttccaagtctttgctattgtgaatactgccgctataaacatacgtgtgcatgtgtctctatagcagcatgatttatagtcctttgggtatatacccagtaatgggatggctgggtcaaatggtatttctagttctagatccctgaggaatcgccacactgacttccacaatggttgaactagtttacagtcccaccaacattgtaaaagtgttcctatttctccacatcctctccagcacctgttgtttcctgactttttaatgatcgccattctaactggtgtgagatggtatctcactgtggttttgatttgcatttctctgatggccagtgatggtgagcattttttcatgtgttttttggctgcataaatgtcttcttttgtgaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagttcccatttgtcaattttggcttttgttgccattgcttttggtgttttagacatgaagtccttgcacatgcctatgtcctgaatggtattgcctaggttttcttctagggtttttatggttttaggtctaacgtttaagtctttaatccatcttgaattaattttagtataaggtgtaaggaagggttccagtttcagctttctacatatggctagccagttttcccagcaccatttattaaatagggaatcctttccccactgcttatttttctcaggcttgtcaaagatcaggtagttgtagatgcgtggcgttatttctgagggctctgttctgttccattggtctatatctctgttttggtaccagtaccatgctgttttggttactgtagccttgtagcatagtttgaagtcagggagcgtgatgcctccagctttgttcattaggcttaggattgacttggcgatgcgggctcttttttggtttcatatgaactttaaagtagttttttccaattctgtgaagaaagtcattggtagcttgatggggatggcattgaatctataaattacattgggcagtatggccattttcatgatattgattcttcctacccatgagcatggaatagtcttccatttgtttgtatcctcttttatttccttgagcagtggtttgtagttctccttgaagaggtccttcacatccgttgtaagttgtattcctaggtattttattctctttgaagcaattgtgaatgggagttcgcttatgatttggctctctgtttgcctgttattggtgtataagaatgcttgtgatttttgtacattgattttgtatcctgaggctttgctgaagttgcttatcagcttaaggagattttgggctgagacaatggggttttctagatatacaatcctgacatctgcaaacagggacaatttgacttcctcttttcctaattgaatacactttatttccttctcctgcctaattgccctggccagaacttccaacactatgttgaataggaaaggtgagagaaggcatccctgtcttgtgccagttttcaaagggaatgcttccagtttttgcccattcagtatgatattggctgtgggtttgccatagatagctcttattattttgagatacgtcccatcaataccaaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttttgtctctgcccggctttggtatcaggatgatgctggcctcataaaatgagttcaggaggattccctctttttctattgattggaatagtttcagaaggaatggtaccaattcctccttctacctctggtagaatttggctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctcttttcttctttattagtcttgctagcggtctatcaattctgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccatctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttgttttacatttgctgaggagagctttacttccaactatgtggtcaattttggaataggtgtggtgtggtgctgaaaaaaatgtatattctgttgatttggggtggagagttctgtggatgtctattaggtccgcttggtgcagagctgagttcaattcctgagtatccttgttaactttctgtctcgttgatctgtctaatgttgacagtggggtgttaaagtctcccattattattgtgtgggagtctaagtctctttgtaggtcactcaggacttgctttatgaaactgggtgctcctgtattgggtgcatatatatttaggatagttagctcttcttgttgaattgatccctttaccattatgtaatggccttctttgtctcttttgatctttgttggtttaaagtctgttctatcagagactaggattgcaacccctgcctttttttgttttccacttgcttggtagatcttcctccatccttttattttgaggctatgtgtgtttctgcacgtgagatgggtttcctgaatacagcacactgatgggtcttgactctttatccaatttgccagtctgtgtcttttaattggagcatttagtccatttacatttaaagttaatattgttatgtgtgaatttgatcttgtcattttgatgttagctggttattttgctcgttagttgattcagtttcttcctagcattgatggtctttacaatttggcatgattttgcagtggctggtactggttgctcctttccatgtttagtgcttccttcagaagctctcttaggtcaggcctggtggtgacaaaatctctcagcatttgcttgtctgtaaaggattttatttctccttcacttatgaagcttagtttggctggatatgaaattctgggttgaaaattcttttctttaagaatgttgaatgttggcccccactctcttctggcttgtagagtttctgccgaaagatcagctgttagtctgatgggcttccctttgtgggtaacccgacctttctgtctggctgtccttaacattttttccttcatttcaactttggtgaatctgacaattatatgtcttggagttgctcttctcaaggagtatctttgtggcattctctgtatttcctgaatttgaatgttggcctgccttgctagatttggcaagttctcttggataataccctgcagagtgttttccaacttggttccattctccccatcactttcaggtacaccaatcagttgtagatttggtcttttcacatagtcccgtatttcttggaggcttcgtttgtttctttttattcttttttctctaaacttatcttcacacttcattttattcatttcatcttccattgctgataccctttcttccagttgatcgcattggttactgaggcttgtgcattcatcacatagttctcgtgccgtggttttcagctccatcaggtcctttaaccacttctctgcattggttattctagttgtccattcgtctaattttttttcaaagtttataacttctttgccattggttcgaacttcttcctttagctcggagtagtttgatcttctgaagccttcctctctcaactcatcaaagtcattctccatccagctttgttccattgctggtgaggagctgcattcctttggaggaggggaggtgctctgattcttagagtttttggtttttctgctctgttttttccccatctttgtggttttatctacctttggtctttgatgatggtgacgtacagatgggttttcggtgtggatgtcctttctgtttgttagttttccttctaacagtcaggaccctcagctgcaggtctgttggagtttgctggaggtccactccagaccctgtttgcctgggtatcagcagcagaggctgcagaacagcagatattggtgaactgcaaatgctgctgcctgatcattcctctggaagttttgtctcagaggagtagctggccatgtgaggtgtcagtctgcccctactggggggtgcctcccagttaggctactcaggattcagggacccacttgaggaggcagtctgcccgttctcagatctcaagctgcgtgctgggagaaccactactctcttcaaagctgtcagacagggacatttaagtctgcagaggttattgctgtcttttgtttgtctgtgccctgcccgcagaggtggagcctacagaggcaggcaggcctccttgagctgtggggggctccacccagttcgagcttcccggccgctttgtttacctactcaagcctgagcaatggcgggcacccatcccccagccttgctgccaccttgcagtttgatctcagactgctgtgctagcaatgagcaaggctccatgggcgtaggaccctctgagccaggtgcaggatataatctcctggtgtgccgtttgttaagcccgttggaagagcgcagtattagggtgggagtgacccgattttccaggtgccatctgtcacccctttctttgactaggaaagggaattccctgaccccttgtgcttcctgggtgaggcgatgcctcgccctgcttcggctcacgcacagtgcactgcacccactgtcctgcacccactgtccggcactccccagtaagatgaacccggtacctcagttggaaatgcagaaatcacccgtcttctgcatcacttatgctgggagctgtagactggagctgttcctattcggccatcttggctcccaatgcaaagaccttcaaacaacgtgacttcattttctcactcctaccttttgtgctcttgtcatttatttgaattctacatatattttaaaccccataagacattattattgttttatataatcaatatcatttatatatatatatatatttacacctttcatttctttcattcttttctgcatttcttgcttccatctatgatcattttctttttgtctgaagaaacttctttggaacttccttcagtgtgtgttggctagtaaaaagttctctgtcagtttttggtcagaatgggtctttattttgcctagatacaagtccttggttggatttacatattgtgaatgttttctcccagtctgtggtttgtcttttcactcctttaagggtgcattatggttaatagaagttcttacatttaattaattcttatttttcagttttttatggttaatgccttttgtattctgtttcagaaatttttgcctatcctaagaacatgatgccatccttctatattttctttctacatattttaaatattttcttctagaagtctgattgctgtgttgttcacaattaagtttatgattcatttttaattaattttgatggagtgatgcagataaaagttcatttttccatatggatatttaattgctctagcaccaattgttggaaaaaaataatttcctcactgaattgcactgttgtctttgccatgaatctgatgactgtatcactgtagctttgtttctgtactctatttcaggggtaggttatgatccacaagccaaatttgcagcttgtttttatatggcattgagctaagaatttttttacatttttaaagaattgtcacacaaaacaaaaaaaaagcaaaaaaacaaataaggatatgtatcatggaccatatgtgtctacaaacctaaaatatttactatgttgctttttacagaaaaagtttgccaacccctgatctcttatattccattgacttattggtctatctttgtaccagtaacatactatcttatagtaagttttaatatttgttagtataattcctccaactttgctctctttgatttttatataaattttagaatcatcttgtcaattttatcaataaaaatatcttctgaggttttgatagggattacattgattctgcagatcaatttgggggagcatacctcttgacaatattgagtattcctgtccatgagcatggtttagttatttatttacatcttttaaattttctcttggcaatgtttttgtaaaattttagtgtacaggtcttgcacatttttgtaaagtgtattctttggtatttaatgctattataatattttttatggtatcagtttttgtcaattgtgtttttctagaaatatgtccctttcatctaagttgtttaatttacttgaagtaagttatttgtaatgttcttttatcatccttataatgtctgtactgatgtctccgttttcatacctgatattgttatttatattttatctattttaagtttatcgcctgcacccactaactcgtcatctagcattaggtatatctcccaatgatatccctcgcccctccccctagtgcacatgtaccctaaaacttaaagtataataaaaaaaaaaagtttgtcgcctttgttataggttcatcaaatttactaatcctaccataggatcaaatttttgctttgttcatcaggtcatggaattaaaaaaatttttttgttttgtttattttctatgttgaatttttatttttattttgctttgcatttcatttatttctggtcttttgttattattccaatactttctctggattcagttttctttttcttcttgacttcttgagattaaaacttggttcattgattttcaacatttcttactttttaaaagttcatacaaagcataaatttccctttatatactgctttaaccccatatcacaaattttgatgagtcatatttttattatcattgagtttaaaatattttataaattttacgttatttcttgttttattcatagttattttacagtgttttacttaatttcccaatatatggcgattttctggctctctctctgttgctgatttatttgttttactgtgatcacataacatactctatattatttcaatcatttgaaatttgttgagacttgctatatgcccagtgaataatttaatttgattaatggcccactgcatttgaaacaaatatgtctttgctgttattgggtagagtgtcatatatttgcctattatgtcaagttgctttatcatgtttttaaaatccttataaacttcctgatattttatctgtttcttacagacatggaggaaactgtgacatctctgtgattgttgagtttgttattttgatttttgtatttgttagtaagaatgtttcaaaataaatgaggcaatataaaatcaggtgcttacaactttaaggttgtattcttattaaatcaattctttcatctttgtgaaatgtcctttttgtctgaagtagtacttgttgccttaaacgtctgcattgtctaaaatttatacacctgcactatcatatttattttgcttaatgtttgtgtggtatatatttcccattcttttcttttcaacctatctctatccttatatttacagtgtgtcttttttaacattttctgtagtgcaagtctgttggttaattaattttgtcagtttttgcttctctgaaaagtctttatttctgtttttgaattatatcttcactgtgtatagaattctgggtttgtggttgttgtttttgttttattacattttgttttattggtttttccctcagcactttaaaaatgccgctccattgtttctacttgcatagtttttcacaataagtttgttgtaattcccatttgcattcaactgtacataatgtatctttttaaaaaaatctggatggcttcaagctctttactttgatttttgtgtgtgtgtgtgtgtgtgtgtgtgtgtgtgtgtgtgtgtgttactttggcattctctaggcttattcaatctgtaatttggtatcattaattttgaaaaatatttatcatctgtgtcttcaaatattgcttctaattctttctcttcttctggtattgcatttacatatattatactgttcaattttgtcacacagctcttgaatatgctgttctagtttgttttctaactatttttccttctagttgttcagttttgttgacatttattgacctatttttacttcagtaattgtttcctgggttgttgagttaattgatgaactcatagatgacatacaatttatctttttattcttgtgtcacttgtgcttttgatgtcacatctaggaaggctttgtctagcccaaggccacatttacttccatattttcttctaagagtttgatagttgtagctgttacatatatgtctatgatctagtttgaataaatttttgtgtatggtgtgaagaagaggtctaacctcttttttattttttgcatgtaaacatccagttgtcccggcaccatttgttgaaaatatgattcttttcccattaagtcatcttgacacccttgttgaaaatcaattgaccataaatgtgagagtttatttctgaactctccattctgttccattgacccatacgtcttctataaattcttatagctaattctacattagactttggtttttcagatgtggtcatctcattagattatggtgatatgtttggttacaagttttatcttctccttggcaacattttttttattactgctcttcttttattcgtttttgttgttcctttctctttttgtgagacagggtctcactctgttgcccagggtggagtaagtggtgtgatcatggctcactgcagcctcaacctcctgggctcaagcaatcctcccacctcagcctcccaagtagtgggactacaggcatgcaccatcatgccaggctaacttttttattttttgtagagacagggtcttgctttgttgcccaggctggtcttgaactccaagctcaagcaatcctccaacctcagcttcccaaagtgctgggattaccagtatgagccactgcacctggccttgttgttcctttcttccttttatcttgtagtatcttgatcctttttgcttattatttatcattgaggtgagtttgttctaaataaacttttcgcagaaagtttatgtagatatattaatatcaatgaggcattaggagtgagttttagattagcaggaattctcttatgaaaggtattgattgtatgtgtgagttttcagcctttacttctctccagcccatcaagatcaaagctgcagagttgtttacatttcagaatttctttcctcccctccccaccttgcaaaacagacttacagtgcaaaaatgacttgtcaatgtgattctttcttctggtcccatctttcctaccttttgagacttgtgttgaaaggagtccagtaaaaccaccgatgctagcttgtataccctgatcccattgttataatgaatgactgactgtttttcatatcaaagtataatacttgcaccttgatagaagaaagaaacaaggccaggcacagtggttcatgcctgtaatcccagcactttgggaggctgaagtaggaggaataattagactttgatattaaaaatggggaagatatggcggtataagatatgaggaagtatgtcttcttggacttttctgaaatctgccagccatgagcatccactctttttatcttttgatacctgttttatattaactatacttctattttgtggtttcatggcttcagatatcttccagcttaattgtactctgtctttaattatttgcagcaatttctgaaaggagcaagaagaaaggccagccctttcttcactaccttaaaaactggtcatcttttgaaaccccatgaaaggcacagtgggtgaccatctacatcaggagtgggcaaactatggcccttgggtagtctggtctctgtccgtttttgtaaggttttattggaacccatacacacacaaactgatcatctcttgttatgtgttaagttttcttataattattcttttctatttcatccagctgaattaccatttcaccttgtgtatgccctttccagtcttaaattatagaagctatgtctttgtggttttaaattatggaagctgtgccttcttgtgttttagtatggcaagatatttgttcttacttttcctctagaatctgcagtggattactttcagaagtaggtattgcctctaagtttcctgacttctgtttccttctccctgttctgtagtatatttatagattgcatgttttctcgtccttaaacaaggtacaaatatgttctgatcaaggtttgctagccgagaggataagtggcttgctcttagcctaactctctgtctacttaatggatgtcgaattcccttctcaactcaacagctagtaactagttccaagatcggataatagcttacagaattaattagttcagtgaaagccctggtttgatcacagaggcaggagactgatctatatatttgtagtgctgactagaccccaacttggccagatagcttatacctatgtcagaagttggaggaggagattgacagctgaggtgtctccaagggaattacaattattttcattttctttgtgtctgtaattatgtctcttttcttacttcaaattttgtatatgtgaaatttcttaatttttatttggttatttattttattgactttttcatcaaacaaccaactctaagttcttggattgaaatttatgaattaattataatgttttaaatttaccattagtcacacatacaatacaaaaagatattttcattacaaaattttaacccaagccattaaaactaaactccagcttggtcaccattcctaataccaggcccctctcagaggggagggtaaataaaagtccattttggtaactagtttgacgagaatctctaattgtttccctgtttttcttataatgtctgcctttgaattatcctctttttttcaagagttccatcatataatgtattcctttttgcttacagattgacctcctagaggcatgcatccccctgctccagtctgagctggttctctctaggcctgaggctcagttatcaacttgggacttttatttaccctccctcaggataggtacctggttcttggataccaggtcttactcttgtttgagatactcctttattttggtggcaaacattccataatcacttcctgataatggtgacatttgaggtagattttctgagtctttatatgttagaatatgtttttattctcctttgccacttgattgataatttggctgcacatagaatgtaagcattcacagggcttttgggagcagcttcccttgagaagaaggtggatgcagttaagatcttccctgaaaagactgtgtgaaatgacaaggctattgaggtacccaacgggtagcttggtaaaggtgtatcttgtctcttatgtttatgcatctactttaccaccatgtaattagcctattataacttgttgcattccttcactcagctaatcttgttcatggtagaaattaatattgctagtaccatggtagaattttatattagctggatcctagacctaaatgctccttccttgtgcttacatattctgcaagtgggtgacagtggatgctaggtattgtgttatgtgatttcaatgtattatatgatggggtagatactattagcctcatttgaaaattagaaacctattgttcagaaagtttaagtgactttctcaaagtcacacagctggtaaatggtagaactgggatttgaatccaggcaatctgatggatttaagaggaacctgtgccactatgtgatatagcaataacatctagccaatataaatactttcctgaattaaatcactgtcatattcagagagttctgtgtcactattaagaccctccattattgtgtatattaattacatttccctattttaatcccaatatctattcatttttatcacagtcctttcttatggtcacaaacaggcatagtacaacagcagcaatgcaaaaaccacttttatattacatgttccagggatttaacccaatgacctgtgatataatgatactgactagtattttttcatttatctgggaatgggagagaacctctaacagaacgttttagaatctgtgttatgagtaaccagagtcttattcttcctcatctccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacaggtatgaatgcattggttattcctttgctctgctcttgtgacatttgactttaccagatgatgacaccaacaatgagagttagaggatgaaaaatcaaggtgtcttgaaactcttactctggtgagatagagagaagagaggtttacaagagggtagaggaatcagggacaagaaggagcaatggggagcaggaagaaagtcaacctcacctatcaaccttatgagctgcaggggaaatcttagtctcatcagagaactttaagcaaggcagaaggaagaagcaagttcgtgttaaagaggttaaggacttggggaggattggttttcatgatactggggatccagagggcaaagtaggatgattttatttttaggtgagtagagggaggttgagcagtcaagtagtacagagaaatgtggaatataaacataaggagagtcagtcagtcacaaatatttatggaacacctactacatgccagacacttttgtacacattggagtgcagcacagcaggagcttatattctattggaaagagcaagagacaagttagtacaaaactaaataaggcaatctcaattgtgttgttcagaagatagaatagaataatatggtagagagaataatatgatagagtaatacggtagagtgttacattagctgtggtggtcatagaaatcatctttgaggagttgagacctaaatgatgataacaggccagctgatggagctctgagagaagatgtttccagacagagggaagagaaaatgcaaaggccctgagaatggaaaaagtttaccatgtttgaggaacaagaagggacaagcatgacttgtcactttcccaccttgctttctagctcaagtaagcccttattgctgcattgcaaccatagactatttccctagtccactgactttctcattctcctggacctctatcttagattttctgtgttttccttaaatctcgagcaccttttttccattctccaatgcccattttcactcttagctgatgctgtgcaatgaacctccacagactcccaacatcacatttactggcatttgtacccatatactctgcctgcacacttattacaataaatagagtgtctgtgctcctaaggccaacctctccagttttgtacttgattcccatctcttctcccttcataaaaaatgttgctccagcaatttctccttttctcccttacatcatcaatttatctctccactagattaatctcatcaacatcaatcatgctattatttcctcccctatctttacagaaaccgtcttaaaataattgtccctgcttgcagcctttgcatcttttcctgccattctctcctctttaacccactccaaagaagcttttatctctattatttcataagaactacattttcaaggtcattattgatctttacattactgattactagccctcatcttatttgaattctcagtagtatttgagaggtgattactccatcgttgatacaggttctcacttggtttctctaacaccacttttcttcacttttctactaaacttactgccaatctttgtcaactttgcgagtccttcttcatccccctaatctttaaaggttagagtgctccagggattagttctccaacttcttctttattctatttatactcactctgtgacgacattgtttagcctcatgattttaagtactatctatctgcagataattccagttgaatatctggagatattctcagatctctctcctgaagtcaaaatttacatatcaactccctaccttaacatgcacacaattagactcttaattcctgccccttcccaaaacctgctgattgctcagccttctccatggcaatcaaaaaccattcctggccgggcatggtggctcactcctgtaaccccagcacttggggaagctgaggcaggtggattggttgagccccagagttcaagatcagcctgggcaacatggcaaaacctcatctctattaaaaatacaaaaattagccaggcgtggtggtgcacacctgcagtcccagctactcaggaggctgaggcacgagaatcgcttgaactggggagacggaggttgcagtgagctgagatggcctcactgcactccagcctgggcaacagagtcagacttgatctcaaaaaaataaataagtaaaaccattccctatttcagttattcagtcacagatcttgaagttttccaactctttttttcttacattaacatctaatctgtaaaggatcctgtattagtccattttcacactgctaataaagacatacctgagactgggcaatttacaaaagaaagaagtttaatggactcacagttccacatggctggggaggcctcacaatcatggcagaaggcagggaggagcaagttatatctcacatggatggcacaggcaaagagagagagcttgtgcagggaaactcctctttttaaaaccatcagatcttgtgagacttattcactatcatgagaacagcaagggaaggacctactgccatgattcagttacctcctatcaggtccctcccacagaacatgggaattcaagatgagatttgggtagggacacagccaaaccatatcattccaccccatcccctcccaaatctcgtgtcctcacatttcaaaaccaatcatgccttcccaacagtcccccaaagtcataacacatttcagcattaactcaaaagtccacagtccaatgtctcatctaagacaaggcaagtcccttccacctatgagcatgtaaagtcaaaagcaagttagttacttcctagatacaatggggtataggcattgggtaaatacagccattccaaatgggagaaattggccaaaacaaagggcctacaggccccatgcaagtctgaaattctacggggcagtcaaatcttaaatctctaaagtgatctcctttgactccatgtcttgcatctgagtcatgctgatgcaagaggtgggtgcccatggtcttgggcagctccacccctgtggctttgcagggtacagcctcccttgtgtctgccttcatgggctggcattttctgtagcttttccagatgctggtgcaagtttctgatggatctaccattccggggtctggaggacggtggccctcttctcacagctccactaggtggtaccccagtagggactctgtgtgggtgccctgagcccacatttcccttctgcactgccctagcagagtttctacatgaaggcccacccccgcagcaaacttctgcctgggcatccaggcacttccattaatttctaaacaacaaagcattcaagaggcgacttgggtgctattaagggcattcagtttcataagggaagcagagcataaaagtttggaaaatttgcagcctgataatgttagagaaaagcaaatcccattttctgaggagaaattcaagcaggctgcagaaatttgcataagtaatgaggagccgaatgttaatccccaagacaatggggaaaatgtctccagggcatgtcagaggtcttcacaccagcccctcccatcaccggcccagaggcctaagaggaaaaagttgtttcatgggctgggcccaggatccccatgctgtgtgcagcctagggagtcggtgccttgtgtcccagccgctacagccatggctgaaaggggtcaatgtagagctcaggctgtggcttcatagggtacaagtcccaagccttggcagcttccacatgatgttgagcctgcgagtgcacagaagtcaagaactggggtttgggaacttccgcctagatttcagaagatgtatgaaaacacctggatgcctaggcagaagtttgctgcgggggtgggccctcatggagaacctctgctagggcagtgcagaagggaaatgtgggctcagagcacacacacagagtccctgctggggtaccacctagtggagctgtgagaagaggaccaccgtcctccaggccccagaatggtagataccctaaatcatctctttcaaattcgaagttccacaaatctctaggacaggagcaaaatgccaccagtatctttgctaaaacataacaagagttacctttgctccagttcccaacaagttcctcatctctatctgagaccacctcagcctggatttcattgtccatatcattatcagccttttggtcaaagccattcaacaagtctctagagagttccaaactttccacattttcctgtcgtcttctgagccctccaaactgttccaacctctgcctgttacccagttccaaagtcgcttccacatttttgggtatcttttcagcagcaccccactctactggtaccaacttactgtattagtctgttctcacactgctgataaagatatacctgagactgggaaatttacaaaggaaagaggttttatggacttactgttccacatggctggggaggcctcaaaatcatggcagaaggcaaggaggagcaagtcttgtcttacatggatggcagcaggcaaagaaagaaagcttgtgcaggaaaactcttttttttcttttcttctttttagacagagtcttgctctgtcacgcaggctggagtcagtggcgtgatcttggctcactgcaacctccacctcccgggttcaagtgattctcctgcctcagccttccaagtagctggtactacaggcatgtgccaccacatgagatgagattttggtagggacacagccaaaccatatcattccccctgtcccctcccaaatctcatgtcctcacatttcaaaaccaatcatgccttcccaacagtcccccaaagtcataactcatttcagcattaactcaaaagtccacagtatttttagtagagatggggtttcaccatattggccagactggtctctaactcctgaccttatgatccgcccgccttggcctcccaaagcactgggattacaggtgtgagccaccatgcccagccaaaaactcttctttttaaaaccatcagttctcatgagacttattcactatcacaagaacagcataggaaagatctgcccccatgattcaattacctcccaccaggtccctcccacaacacatgggaattcacgatgagatttgggtggggatcctcttggctatcatttcaaaaaatagtcagggttgattatggacttagtattgaataagatgaaaatgtactgaaatggaacgatgaagataattgaccagggaaagcaggttacaagccaagagaggatacagtgtcacttcagatgctataaaagtgatgtttttattttttgaatgttatttggctatattttcaaattatctgcactgcatatgcactgcttctgtaataataaaagggtattaaaataataaaatcaagtctataaatcacacacacacaccccagcctcttctctacacctcagtgactaccaaccacatctaaattatcatcatttctcatctgaattattgcaagaagccattgcaataattcagatgagagttgatacaaagccttcctgtttccaaccttaccctcatatagtcttttcccaacattgcatctaaagtaatttttcaaattgcaattctgatcactgttctctgcttcagatcctccagtggattttcatctcactcagtaaattccaaagccttcaccatggccttcaagaccctacgaaatttgaccctctgcaacctctctgccttcatctgttaccattgtctcctgttaatcctgcctcagccacactgacctccttgttcttctcaaatggactagatgtgtgcctatctctagaccattacagtttctgttctctctacttaaaattatgtccctgatactctaatgcaagttctcttacttccttcaggacgctgctcaaatttcattttatcagtgaggctttccctgaacactgtatgtaaatattgctcccaccattttttttcaatgcacttaacagtgcctgaaatattatatatttatttctttattgtctatcttctctgactataagttaagctcattaagaacacaaactttggaggtattgttcaatgttgtgtccccagaactttgaacagtgcctggcacgtggcagatgttcaaataaatgtatgttgaatgaattagaaaatgataaatgtagggagacaaaagcaggtctcccatttatatccaaactctaggactctaggaaagactgattatatggaatcgtgtcacacagcatccatgggcaagagtggaggcagagataccagttaagatgctattgcagtcatacagataaaagaagacagttatttagaccagtgtggtggtgacagaaatggaaagaaatggaaggatgttgggtataattaaagataagcatataagactggctgttaattgagtatgggaagaatgaggagagaggatgtaaagaacatttctttttgtttgtttgttttgttttgtttttgtttctttttattatactttaagttctagggtacgtgtgcacaacctgcaggtttgttacatatgtatacatgtgccatgttggtgtgctgcgcccattaactcatcatttacattaggtatatctcctaatgctatccctccctcttccccccaccccccaacaggccccggtgtgtgatgttcccctacctgtgtccaagtgttctcattgttcaattcccacctatgagtgagaacatacagtgtttggttttttgtccttgcgatagtttgctgagaatgatggtttccagcttcatccatgtccctacaaaggacatgaactcatccttttttagggctgcatagtattccatggtgtatatgtgccacattttcttaatccagtctatcattgatggacatttgggttggttccaagtctttgctattgtgaatagtgccgcaataaatatacgtgtgcatgtgtctttatagcagcatgatttatagtcctttgggtatatacccagtaatgggatggctgggtcaaatggcatttctagttctagatccctgaggaattgccacactgacttccacaatggttgaactagtttacagtcccaccaacagtgtaaaagtgttcctatttctccacatcctctccagcacgtgttgtttcctgactttttaatgatcgccattctaactggtgtgagatggtatctcactgtggttttgatttgcatttctctgatggccagtgatgatgagcatattttcatgtgtcttttggctgcataaatgtcttcttttgagaagtgtctgttcatatcctttgtataagattattagtggatttctcagaagaaatattgtagaccagaagggagtgaaaatatagatttaaaatcctgaaaggaaataaaaactagcaatgaaaaatactatatccagtaattttatctttcagaaatgaaggggtgataaagattttctcagaaagacaaaagctagatctgctttataagaaatgctagtaggagttcttcaagctgaagaaagaggatgcttattagtaatatgaaaacatatgaaaggataaaactcactagtaaaaataagtacattgtcaaatccaaaacactctagtagtgtaatggcagtgggtaaattaattatatctttagtataaaagataaaagacaaagaaagctattttaaaaactaaagctataataatgtgttaaggaatgcaaattattaaaatatgtaaactgtcacatcaaaaacataaaataggctgggcacagtggctcatggctgtaatcccaacactttgtgggggccaaggtgggaggatcacttgagcccaggcatttgagactaacttgggcaggatagtgagatctcatctctataaaaaatttaaaaattagtaaagcatggtggtgcatgcctgtagtcccagctactcaggaggtggaggtgggaggactgcttgagcctgggggggtcaaggctacagtaagcaatgatcacaccactacactccagcctgggcaacagagcaagaccctgtctcaaaaaaaataataatatgtaggaggaagggaataaaagtgtagagtttgtggatgcaataaaaattaagttgttatcagtttaaaatagcctgctaattttgtgtaagcctcatagtaaccacagagcaaaagcctatagtagatacacaaaacattttaaaaaggtccaaagcataccactacagaaagccatcaaactataaaggaagaatgcaacagaagaagaaaggatcaaaggatctaaaaaaaaaaaaagaaagaaagcaattaacaaaatgacacaagtatgaccaaagtccactgcttctttattactgatatagaatatctttcagatcttaagggactgattaattacttgggagagaaagtttgtgttgagaagatttgcttgtgttgcaatgagaaggggaagttctactcaacagaagctgtacaggcacatatgacaaaagctggtgtaagctttttacagatggtgatgctgctttggaatttgcagacttgtatgagtttaggagtagctacccagatcacaaggaaggggaggaccctaatgaggctgaggagtcgcccttaggaaaggacttagaatatgatgatgaaagcatggaactgattctgccttctgatgccagagtgggtcatcactccttgatgagatactacaaacagtgatttggcttgtcaagagctgtggtagttgctaaatattgtgaggccatgggccgagtgcttcagtaatagagagccctgggatagactggcaacacaggagcagctgttacatgaaagtgagacatgcattatatccaaaggatgaagtcaaaatggatgctgaagacagaaatgaagaacaatgccaccaagcagatgcactttagggtccaagtgagattctgagagtctgccaggattgagtgattgtctgctgcccaagtttcctccttgccctgaggaccagggaaagccagattgtatgatggacacttttgctgctacttcacttgctctaacataataataaaaatgaaaatctaaaaaatattttattgaagaatgaaggtgaaagaaatacattttcagacaagcataaacagagaaacttcaccattagcaaaagtccactaaaatattctaatgttatacttgagacaataaaaaagtgatacagaatggaaggcatgagagacaagatgggataaagagcaaacaaagttaaatatgtggataaatagagataagtatcataaaacatggtcaaatgttttatgagcgttaagatatatagaattgctttattcacagttggtttgctgtcataacacaagtatcatgaaaatcactgctaaatctaagccaaaattgggaaaggaaaaggttcatgtcactatcatcaacgttggacatgtagactcaggaaagttcaacactactggtcatctgatctataaatgtgatgtgatcaacaaaggaaccattgaaaaatttgagaaagaacctgctgagatgggaaagggctcatttgagtatgcttgggtcttggataactataaactgaacatgaatggaatatcaccattgatatctcctaaagaaacctgaggccaaaaatatcctgtgaccatcattgatgccccagcacacaggggctttattaaaaaaaaaaaaaaaaaaaaaaacatgattagagtgatatcaccaaaatggtggatagaagcaatctggcttcactctcctccagaaaaaccaaaaacaactattcagtgtctagcttatcaccaggaatatcccataactcaaaacagaggctgtgaggatctgagtggccacatagaagagaaaaactgcaagcagaagataacaaaaatgggcctgtttaactgcagcatccccttcccaagctgccaggcaccatgcagaaaagttcccccagactgacagtatgtacatcagaaaaagtgacatctagatgaagagccagctttcccaccatcttgggttcctttgcagaaaaatcattcctgcctcaatccgtgggaagcagcctgattgcctctagggtaaaaaaatcctgagggcagctagagacaaaggatggaggcggggctagcaaccccagcatgcaaaacacattggctgctcttcatctaagccaaagaagacaccaaatgagagagaatgttcagcccgtggttcctctggacacaaaatcctaaccagatgtctcacccaaccaggatatccagtttgggacctcccccaaatcgggaataggcagtaatccaagccgttgcaagagctgcagcaaatctgggcttacagcaccatctagtgccaaaaaagaggcagtaatctcagagtaaggaagctctaattcatacataacctttagacaggcatactcctgaaaaaccaaactaagccagacacaaagactggaataaataacttagcattcatacaaagacatagatatatgtgcataaaaaacaagagcaaatagggagctatgacctctccaaatggaaacagcatggagccagtgaccaaccctaatgagatggcaaattgtagctctcaaatcaataattcaaaataaaagttctgaggaaactcaaagaacacaaaaaagcaactgagaaatttatgagataaatttaacagagaaatcaaaataataatttaaaaaaccagaaatgctggagctgagaaatacaactgaacggaaaaaaaaaatgcactggaaagtctaaacagcggaactgatcaagcaaaacgaacaatcaatgagctcaaagacaggctatttgaaaatacacagtcaaaggacaaaaaataattaaaaggaatgaagaacacttgcaagatctagaggactgcctcagtagaacaaatctaagagtcatgggccttcaagagagaaagagcaatgaataaaaagctcaaagaaataacagaaaatatttccaaacctacagagagatgtaagtatccagttataggaaggctgaagatcaccaaacagattcaacccaaataagactaccccaaggcatacaataattaaactctcaaaggtcaaagacaaagaggggatcctaaaaagagcaagaaaaaagaagcaaataacatataaaggagctccagttcatccgggaatatactctggaccagatgaacctacctgacattttacagaacattttatccaactactacagaatatacattcttcttatcagcacatggaacattctccaggatagactatatattaggccagaaaacaagtctcaacatttaaaaaaataaaattatattaagtatcttttctgactacagtagaataaaactagaaatcaatgacaagaggaacgtttgaaactatacaaatacatggaaattaaacaacatgctcctgaacaaccaataagtcaatgaagaaattaagaaggaaatttattgaaacaaatgaaaatggaaacaacataccaaaatgaatgggatacaacaaaagcggtactaagagagaagtttatagctataaatgcctacatcaaaaaagaaagactcaaataaacctggtaatgatgtaactcaaggacatagaaaaacaagagcaaaccaaacccaaaattagtagaaggaaaataataataataatcatagaaataaataatattgagaaaaagaaaacaatatgaaagaccaatgaaatttttaaaatggctttttgaaagataaaatttaaaatctttagctagactaaggaaaaaaaatgagagaagacccaaataattgaaatcaaagatgaaaagagtcattaaaactgataacacaaaaatacaaagtttcactagaaactattatgatcaactatatgccaacaaactggaaaaactagaagaaatggataaatttctggacacatacaacttaccaagattgaactatgaggaaatagaaaacttgagcagaccaataactagtaatgagattgaagcagtagtaaaaagtctggcattaaataaaagtccaggacctgatgacttcactgctgaagaaaaacttacaccaattatactgaaactatttaatattgcaaaaaattgaagagaaaagaatgtttccaaactcattctacaagaccagcattatcccaatacccaaaccagacaaagacacaacaacagcaaaaagaaaactacaggccaacttcgctgatgaatatagatgcaaaaatcctcaacaaagtactagcaaactaaattcaacaacacattaaaatgagtatttgtcatgcccaagggggattcatcctaggaacacaaagatagttcaacatatggaaatcaataaatgtgatacaccacattaacagaaggaaagacaaaaaccatatatttatttcaataaatgtcaagaaagcattgaataaaattcaacatcccttcatgataaaaactctcaacaaatttggtttaaaggagcatacctcaaaacagtaaatgttatatatgacaagcccacagctaacattacaccaaatgggaaaaaattgaaagcctttcctctaagatctggaacaagacaagcatgcccactttcatcaattctattaaatgcagtcctggaagtccaagatggagcaattaagcaaagggccttcaaattagaaaaaaagaaatcaaattccccttgtttgtagacgatataatgttatatttagaaaaacctaaacactccaccaaaaaactgttagaactgatcaacaaattcagtagagttgcaagaagcaaaaccaacatacaaaaatcagtagcatttctatataccaagagctaacaatccgagagagaaatcataaaagcattttcattttcaatagctataataaaaataaatatctaggaacaaatttaaccaaagaggtgaaagatctctatactgacaactgtaaaaccctgatgaaaggaattgaagaagacacacaaaaaatgaaaaggtatctatcccatgttcatagaatggaagaattcatattgttaaaatatcaatactactagatttcatgtattacctatcaaaataccaataacatttttcacagaaatagaaaaagcagtcttaaaatttgtacagaaccacaaaagacccagatatggtttggctgtgtccccacccaaatctcatcttgaattgtagttcccataatccccacatgtcgtgggagggacccagtgggaagtgattgggtcatgggggcagttttcccccatgctgttctcgtgatagtgagtgagttctcatgaaatctgatggttttctaagtgtttggcatttcccctgctggcacttattcccactgccaccttgtgaagaagatgccttgcttcccctacgccttccaccatgattgcaagtttcctgagacctccccagcaatgcggaactgtgagtcaattatacctctttcctttatagattacccagtctccagcagttctttatagcagtatgagaacagactaatacagtaaattggtaccgaggtagggggggcactgctataaggatacctgaaaatgtggaagcaactttggaactgtgtaacaggcagaggatggaacagtttggagggctcagaagaagacaggaaaatgtggcaatgtttggaacttcctagagacctggagggctcagaagaagacaggaaaatctgggaaagtttggaacttcctagagaatcattgaatagctttcaccaaaatgctgatagtgatatggacaatgaagttcagactgaggtggtatcagatggagatgacgaacttgttaggaataggaataaaggtggctcttgctatgctttagcaaagagattggcagcattttgcccctgccctagagatctgtggaactttgaacttgagagagatgatttggggtatctggcagaagaaatttctaagcaacaaagcattccagagtgacagagcataaaagtttgaaaagtttgcagcctgatgatgcagtagaaaagacaaacccattttctggggagaaattcaacccagctacagaaatttatataattaacaaggagccaaatgttaatcaccaagataatggggaaaatgtgtccagggcatgttagagaccttcgcagcagcccctcccatcacaggcctggaggcctaggagggaaaaatgctttcgtggcctgggtccagggctcccctgcagtgttcagcctgggacttggtgccctgtgtcccagccactccagctataagaggccaaagtacagcttgggctatagcttcagagggtgcaagcccccagcctttgttctgtgggtgcacagaagacaaaaattgaggtttgggaatgtccacctagatttcagaggatgtatggaaatgcctggatgtccaggcggaggtgtgctgcagaggcagagccctcgtggagaacctctgctagggcagtgaggaaaagaaatgtggggtgggagcccccacacagtcaccactggggcactgcctagtggagctgtgagaagagggccactgtcctccagaccccagaatggtagatccactgagagcttgcaccgtgggcctggaaaagccacaggcactcaatgccagcccatgaaagcagccaggagcagggctgtaccctgcaaagctatgggggtggagcttcccaaggctgtgggagcctgccttttgtatcagggtgacctaaatgtgagacacggagtcaaaggagaacattttggaactttcaggtttaatgactgccctattggatttcagacttgcatggggcctgtagcccctttgttttggccaatttctcccatttggaatgagtgtatttacccaatgcctgtacccctattgtatctaggaaggaactaacttgcttttgattttacaggctcataaacagaagggattttccttgtctcagatgagactttggacttggacttttgggttaaggctggaatgagctaacactttgggggactgttggaaaggcatgattctgtttttaaatgtgaggacatgagatttgggaggggccatgggtggaaacatatggtttggctctgtgtccccacccaaatctcatcttgaattgtagtatattgtttgtaaaaattcctgcctatccagagattttttaaaaaaaaacaatactttcttcaattttctcttacaatttaattttttacatttaactttttaatacttcctgtagactaaaagttattttggtgcattgtgtgaaccaaagatcaaagtagttttatttttttctgaaaacatctattcattttttcaattaattgattgtttatattaaggatctaggaggatctaaaattatggaattgtgggcaagggcaatttttgccttacatttcatgtaaggcaaaataatccccatgtgtcatgggagggacccagtaggaagtgattggatcatgggggcaggttcccccatgctgttctcatgacagtgagtaagttttcatgagatctgatggttttataagcatctggcatttccccttctgtcacctctccctcctgccaccttgtgaaaaaggtgccttgcttccccttcaccttccaccatgattgtaagtttcctgaggcctctccagccatgtggaactgtaagtcaattaaacctctttcctttataaattatgcagtctcaggcagttctttataccagcaggaaaacagactaatacagaccctaaatatccaaagcagtcctgagcaaagagaacaaagctggaggcatgatgctactttatttcaaactatactacaaagctgtagtaaccaaaacagcatggtactggcataaagacagaaacatatgccagtggaacacaacagagaacccagaaatgaatccacacatttagagccaactcatttttgacaaagtgccaagaatatgcattggtgaaagaatagtctcttcaataaatgatgttgggaaaactggatatccacatgcagaagaattaaactaaacccctatctctcactgtatacaaaaattaaatcaaaatggattagagacttaaatatacaacctgaaagtatgaagctactggaagaaaacattggggaaatgctccaggacattggtctgggaaatattttatggcctgggaaatatcaaaagcacagacaactaaagcaaaagtagacaaacgggattatatcaagctataaagcttccgcacaacaaaggaatcaattaacaaagtgaagggacaacctacaggatgggatgaaatatttgcaaactatacaactgagagggtattaataaccagaatatataaggaactcaaacaagtcaatggcaaaaaagcaaaggatcctattaaaaatgaacaaagatctgaataaacatttctcaaaagaaaacatacaaatggccaacaggtatatgaaaaactgctcaacatcactaattaccagataaatgcaaaccaaaagcacaatggatatttcactccagttaaatgacttttatcaaaaagacaaaaaataatgaatgctgatgaggatgtggcaaaaggggaatgcttgtacactattggtgggagtgtgaattagtacagatactatggaaaagagtatgtatgttcctcaagaaactaaaaatagaacgaccatgtgatccagcaatcccactgctggatatatatccaaagacaggaaatcagtgtatcaaagagatagttgcacaccaacatttattacagcaccattcacaatagctaggatataaaatcaacctaagtatacatcaacagatgaatggataaagactgtgtggtatatatacacaatagactattactcagccattaaaaagaatgaaatcctgtcatttgtggcaacatcgatgagcctggatgtcactgtgttaagtgaaataagccaggcatagaaagacaaatatcacgttttcacttacatgtgagagcttaaaaagtggatctcacggagatagagagtagaatggtgcttaaaggagtttgggaatggtatgggggggtgggatggaatgaagagaggttgattaataggtgtaaaatgaaggggtggcctgcccctcgtcacccacagtgacgagaaacactgtgggtgtttctcgtcaggtgggacgagagactgagaaaagaaataagacacagagacaaagcacaggaaagaaaagtgggcccaggggaccggcgctcagcatacggaggacccgcgccggcactggtctctcagttccctcagtatttattgatcattatctctaccatctcggagagggggatgtggcagaacaatagggtaatagtggagagagggtcagcaggaaaacatgtgaacaaaggtctctgtgtcataaataagtttaaggaaatgtgctgtgccctgatgtgcacgtatacaaacatcttggtgcattaaagagcagtattgccactagcctgtctcacctccagccttaaggcggttttctcttttctcagtaaatagaacatacaatcgggttttacaccgagacactccattgcccagggacgagcaggagacagatgccttcctcttatctcaactgcaaagaggacttcctctttcactaatcctcctcagcacagaccctttacgggtgtcgggctgggggacggtcaggtctttcccttcccacgaggccatatctcaggctatcacatggggagaaaccttggacaatacctggctttccagggcagaggtccctgcggccttccgcagtgtattgtgtccctgggtacttgagattagagaatggtgatgactttttttattattattattatactttaagttctagggtacatgtgcacaacgtgcaggtttgttacacgtgtatacatgcaccatgttggtgtgctgcacccactaactcgtcatttacattaggtatatctcccaatgctatccctccccccaccccatgacaggccccggtgtgtgatgttccccctcctgtgtccaagtgttctcattgttcaattcccacctatgactaagaacatgcggtgtttggttttttgtccttgtgatagtttgctgagaatgatggtttccagattcatccatgtccctgcaaaggacatgaactcatccttttttatggctgcatagtattccatggacaagcatactgccttcaagcacttttttaacaaagcacatcctgcatagccctaaatccattaaaccttgactcaacaccgcacatgtctctgcgagcacagggttggggctagggttacagattaacagcatctcaaggcagaagaatttttcttagtacagaccaaaatggagtctcttatgtctacttctttctacatagacacagtaacagtctgatctctctttcttttccccacagtaaaattacacttaaatagaagggataagttgtagtgttcgatattacagtagggtgactatagttaacaatgatttattgtatgtttcaaaatagctagaagagaagactgggaatgttcccaacacaaataaatgacaaatggttgaagtgattgatattccaattaccatcatttgattattacacattgtattcatgtatcaaaatatcacatgtatccccaaaacatgtacaattatcgtgtatcaatttaaaaatacatcatgataggcacctctcaggttgactgtactgtcctgattattgctagtggtgttaacaaatttgaagctagtatctttaagaacgggcagacccatgagcatgcccttctggtttacacactggaagtgaaacaactaattgttggtgttaaaaaatggatttcactgaactatgccatcgccaacagagctatgtggaaatcaataaggaagtcagccctacattaagaatactggctacaaccgcaacacagtagtatttatgccaatttctggttggaatgctgacaacttgctaacatgccttggttaaagggtggagagtcacctgcagagatggcaataccagtgtagcacaccgcttgaagctctggattatatcataccaccagctcatccaactgacaaggcttgtgcctacctctccaggaagtctacaaaattggtagtattggtaatgtctttgtgggcctagtggtgactggtgccctcaaacccagcatgattggtcagctttgctccagttaacattacaactgaaataaagtcttttgaattgcaccatgaagctttaaatgaagctcttcttggggacaatgtgggcttcagtgtcaagaatgtgtctgtcaaagatgtttatcatggcaatatggcttgtgacagcgaaaatgactcgccaacggaagcagctggcttcctgaaccatccagcccaaatcagtgctggctctccacctctgttggattgtcacacagctcacattgcttgcaggtttgctgagctgaaggtggttgatttccttctggttagaagctggaagatgacccccattgtgatttttattgctatggtttctttctaatttagtcttgaggtctctcccttgagaatggtcataagccaagagagccactttctaggagagtcctgaccagggggaaagttaagtttgagtgtgtcagcttggtgagacacaatgaggaagtaaaaacaaaataaatagtggaatagaatactaacaagtacctagaaataagtctagctaaaaatttgcaaaatgtctatggaaaaaaaaactatggaaatttactgagaaactttaaagagtacctaaataactttcaagatataccacgtacatgaattggaaaacatgatatttgaaaatgtcggttattcccaaactgatttatagattcagtgcaacctgaatgaaaatcccaagacgttccttttgtagagctcaacaagctgattctaaaattaatatgaaaatgtaaaggtttatgaatagccaagtccttcttgaagaggaagaataagatgagagtaattgctgtctaatatattgagacttattttaaagctataataattaaaacaatgtagcagttggtatagggataatcaaacaggtaaatgaaatagaatagaaaatccaaaactagtctaacacatatagaaacttgatttatgacaaaggtgtcacagaagtagagtttcaataaaatgctggaaaatgttggtatctatatagataaaacattacattggattcctaactcacaccatacacaaaaatccattcacattgcattacaagtctaaaagtgaaatataaaatcataaacattttagaaagaaaatgtaaaagaatatatcaataaccacagggtagggaaagaaagagaattgacatcaagatacaaaaagccctagccaataaggtttttttttataaattccacacattaaaattacaaacttatgctcatcaaaagataacataaaaacaatgaaaagattagccacggaatggtaaatgtttgcaatacataacacaaaggacacacaaaggaaacttatataatagattttaacaggcttctctgtgtccttcttctccagcaatcaaggaatatataaaaaagcatatcaaggatatatagggtactcttttgattcaacaagaaaaaagcagattatccaagagaaaacttggcagaaaaaagcttggataggtgctccacaaaagaggacatccaaatgactgctactcataagaaaagatgctcaacctcatagaacatccaaaaatgtaaaaacacagtcaataccagatatttgtaataatttggagcaaatggaactctcatacattgctaatgaaaatggaaaatggtccagctgctttggaaaacagtgtggcaatacctaccaaagccaaacacatgcatacctagtaattccgcccaacagaaatgcacatatatgttcaccaaaagatatgcaccagaaggttatagcaggtccatatgaaagtgccaaagattataacaactcaaatgtccgtgattagggtatattcatataatactatacaacaatgggaatgaacaaactatagctacatatgataatatagatgaatctcacaaccagaatgctaagtgaaagaagaaacaaaagaatatatgtagtatgttttatttacacacttcaaaacaggcaaaactaaactatatttttaaaggatgtatacgtaactggtaaaattataaagaaaagcaaagaaatgattatcataaagatcagaatggtggttaccttcagtgggaagggagaaagtatgattgaaaagggacatccagtgagtcttgtgggttgttggcaatgttactgatctgggtgatgattgcatttatgtaccaaaggcatttgtgttttatgcactttattgtatatgttttagttcacaatttttttagttcacaattttaatagggctttaaaaagtaaaaagaaaagagatccaagggcttgaccatgggactctcttatatttggagtatgtttataaactttacattcattcaacattcgacaaatattttttgagcacctactttgtgccaagcaccgttacaggtgctgggaatacaacagggaacaaaacagacaaaaccccagctttcatggaacttacatgctaataaagcttggcaagagtatttcaaggaagatgaagtggttaactatgcaaaatgcttctcaggcacctaggaaaatgaggatgtgaggcatttctacccacttggtacataaaattattgcttttcctctgctttttttctccagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtgagttaaggacagtggaattacaagaaaattaattttatatatttattttcttgctgactataatgtattcccacttttggaaatttttaaagtatagaaaaataattccataattatctttgtgtacgttctatttttcctatgtatttttctccttatgtattcaaattataccatgcagaattctgattcttgtttttttactaaatatcacatcataaacatttcttacgtcattaaaaacacttcctatgtatgtttttaaaatactgcataatagtctattatatgaatttatggaaccatagtttatgtaaccatttattttgaacaagcttttagacagtttcttttttcactatataaataacgctgtaatcacaacagtttttctaagataaaattccagaagtgcaatgtatttgagcatcttaagagtttttcttattaattatttggtaatgtcccttgcacatttgtctttcatggaggaagtgcttttcttattgattatgttaccttatatattagatagtaaaccactgaacattttaatgagaggtactttttcaagtttttgttttctcttaattttataaatgatggtttttgaaataaaacaggttttaatttttaggtagtaacccatcaatctttactttttgacactttcattgcttttatgtttataaaaattcctgcctatccagagattttttaaaaaacacctatactttcctcagtttttctcttacagtttaattttttacatttaactttttaatacttcctgtagactaaaagttattttggtgcattgtgtgaaccaaagatcaaagtagttttatttttttctgaaaatatctattcgttgtttcaattaattgatggtgtatattaaggatgtagaaggatctaaaattatggaattgtgggcaatttttgccttacattttattttactttccattatattctatgataaatatgtataatttttaatctggaaagtaagccttttttaaaagataatatgcattcattctagaatttgtcatgaagaaccttaacttacatatcaactcctggcgttatggtctcttataacccctgcagtaacattttcccttttactctggaatggcttttatgtgtttaggaattttctcctttgcaactttgagttcataccttaaatttagaatacaaaacctcctcaggattaggtttgagttctaacagcatccatcttctgtaccacttcttccagggtattaaaaactttgataaagaccaaaagacaggtatttcttttagggatgtaaaccctaaggaccttaagatcctagaagattattcttgcttttttttttttgtcgttattgttctacaggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggtaagcaggtgtctattgtgctgaccactttttggtttaaaagaaatggtctttgtgtactaagaattttgatatttatcctacgtgcaataagaagctttaaataggagagttgatcattatatttgtgttttagaaatgtcattctggaatctactgaagaggatggattatatttttggaaggtgggaggcaggttggactggcataaaaattgatgagaaatccactctggttcataggtgagagagcttatactcataggattgatgtcttccctccctaggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatggtaatatattccacatccaaacattatcactgtgaaatgcagattgcactttgacaaatgagacttgatccagggacttgaacattgtatttatttagagtatatctgtgggagtggaatcctcatagatgtcagtttttttggtggagtggagagaaagaaacttatataatagattttaacaggcttctctgtgtccttctccagcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtatgagcttgtttgtgctctttcttctacctactctatttgttgagtacttactttaaatggtctaggcactgggaacacaatcagtgatcaaagcagacaagctccatgctcttaagtaatactttttcaaatgctttttaaaccatttgttcaaagcaaatgaacaagataatttcagatatagaaaaattgctaaaaaggaaatagaacagaataaatggataattaatgtcacagtactttcctagggaaaaggaatttattcctttatcatttaccatctcaaatcccatagggcaccagtagtcatccaaagagtcatttgtttatgtatgtaaccagtatattgattaagcactactcataatgttgatcacaacacaattttattttggttcttcactgtccctttaaaatagatttggccaggtgcgatggctcacacttgtaatcccagcactttgggaggccaaggttggaggattgcttgaggccaggagttcaagaccagcctgggtgacaaagcaagacccccatctctacaaaaaataattagccagacatgtggtatatacctgtagtcccagctacttcacctacttgggtggctgaagtggaaggattgcttgagcccaggaggttgatgctgcagtgagctatgaaagtgccactgcactcaaacttggacaacagagcaagaccctgtctctaaaaaaaaaaaaccatccagtttaatagcgggggtaaactttccttatttcttcgtaaaaattctgataagccctgtaacttttctgctcacccttaagtaataaacaggactaaagtcactttatgtcacaaatacagttcaaatcagaaattacaatgtccatcccaagatattaatcaaaattgtaaacttgatttaacttcaatctcccctcctccaacttgagcctgcatcaggctggaagtctgcattggaaaagggagacatggttgagtcctctgtttctgtaccttgtgatgatcgtgcttccccacaacccctttatagctgctgttttgaactccaacatggataggttaaaggtaaggggataagatagttcttacctatttacagctggcaccattgttgtaaactagcttaacactgtttgtgcctggcaatacttgttgactctttctcctgcagggcactttcagggaactctttagagactcccttacgtgactgtcatgaaatccccttgacatgatttcttccacctttactctgggtggtcacttgtgactcatttctcagccctcagtgttcacctgcagcttcttgttgctggggtaactttacccttgtaggcagctctagtggactggatccagagggaactcaccctgacttatctgtttcacagagtccacatctggccaatgggaaacacaccttttgctcagaaagaccctgggaatgtaggtcaatcataatgcagtagcattctcctgtcccaaccatcaaagaattcagtcaccctgtttctcatctcctggggggaggggagtggtcagaactcaatctccacaacccccaactgtaagggtcacgtagcaagcactttgcatttgaggggtccaaaagtagtggaactaccaaatttggtaggtctactctgatatttcgcataaaccaatgtatctcatgctcattttttagtgaaaagaaataatttctgttcctgttggtttttataaggtgtttttgagacagtggaaatgttaccatccaaagctggaatttggcgggtggaatgccttattggcgagcatctacatgctgggatgagcacactttttctggtgtacagcaatagtgagtagcaatgtgggcagaggttccctacctactcagcctacttctttacagctttcttcctttctggaatggttgcttgtgtcaggaaataaatacaagtttacatcattatcaaatttaaaatgaatattgctggtagaaatcatcagagttctcagagtagggcagatatacttgaagctttgaacactttgtacctgaagctctaaataattgacaaaaaaaaaataccacctcattttcacaacttggtaaagctcgaagatctccagtagcagattttggaatttaatgttgatttagttaccagataacttagaaatactacttggaagagtttggagatttaaccctaaacaagtaagagagccactggtctatttatgtacggaccccagtttcttcagctgtaaaatgtgaatcattctagcacctgttaggattaattaaatgaactaatacagtaaaacgttgagtacagttcttggcacatttaaacactaaaaaatagcatttgttgacgttctcccattttcattgacttacatttgagaagctgaattttgtgcacttctagttactgtgttccacccgtttcatttcagagtgtcagactcccctgggaatggcttctggacacattagagattttcagattacagcttcaggacaatatggtaaatactattatttttgctccaagaacctgggctgattatatctttttttaataatctggtggagaatctcagataatgaatccatctccatgcttctattagttctattccataagtgcctctcaaatacatctcctcctctccacttcccactgtggccatcttaactcaggtcaccatcatttcttacctgggcaatgacactgcctccttaaatatcctccctaccttcagtatttcttccttgagtcaattcttttcagtgcagcaggaagctatactttcctatgagcagtaatggtaaagtttgactagggtctatagagaattctcagaaattgttttagagcactactgcccacaggctaaatgcagcacactgcctgtttttgtatggcatgtgagctatgaacagattttccatttttaaataattgtcaaaaagatgaagactatttcatgacatgtgaaattataaaattcaaatttcagcatccgtaataaagccttattttggaacacagccacgtccattaatttacatatcatctatggctacagcagcagtaacatagttgcaacagagaccatataatatgcaaagcctaaatgatttactatctggccctttacagaaaaagtttgccaacctatgttgttgtgaggtaaaaaaaaatcctcttgaaaaggaggcgtgagagttttacaccaaaatagtaacatttttcactaggtggaagggttacattttaaaatgtcttttatttgtatttttactaatttttacttttcattttctgatttttctacaatgaacatacattgcgtaataaataataggcggggcacgttggctcatgcctcccagcactttgcaaggctgaggcaagcagatcacctgaggtcaggagttcaagaccagcctggccaacatggtgaaactccgtctctactaaaaatacaaaaattagtcgggcatggtggtacgcgattgtagtcccagctacctaggagactgaggcaggagaattgcttgaactcaggaggtggaggttgcagtgagccaagatcatgccattgcactccagcctgggtgacaaagcaagactccatctcaaaaaaagaaagaaaagaagaaataatattattatttggtagtgttggtaacaaattgcagtatcagctagttagaggtgctaacaattaacaaaattataaattttagaaaataaaatggacaacaaggataagcaatatccttagatagtaattgatactggtatgccataaagcctttatgtttttctctattttcaccacagcttagattaacctttctcaagacaataattttattctcaagtgtctaggactaacccagctgaatttaatctctgtttctttacttgggcaaaggacagtgggccccaaagctggccagacttcattattccggatcaatcaatgcctggagcaccaaggagcccttttcttggatcaaggttagaaaatgtaatcaatgatgggaaatgtatcacattcaatcaattgcattacttattcctcttgcaagctcaaaggattctatgaatatgagaaaactaaagaacagaatgccttaatgatttgtacaaaagcagtcatgaacaaagagatatggggatagaattgagtatattgatatgtcctgtttctgtattttagtccttctactgggattagaacatctgaatattttctataatattgaactcgtcatctctcaagacagtatatgttattattagatgcttccaactgcccacgtgtccttaagtactccaatcccctttattttaacataaaacaaatggttcacaaatgcaaaccacatgtgtacttttacattttctgtagccacgttttcaaaaatgtgaaattcactttaataatacattttatttaactcaacatatctgaaaatactatcatttcaacatatgatcaatgaggccccttcaaagacagacagatggaaactcttgggtctcttccatgcctcacaaaagctgagggcagcttggaagtgcctgctcagcctctccacctaaacataaggctagatgccttctagaagcccaaacaggaaatggagaaaacattttggtttccatctttgcaaatagcatgtctattaatgccacagcattgttttgtagacactgccaattttgactcaatctgagctgctgttcactaatccctaagtattttttgttggtttgtgcttctgccaaacaacatgttatgttcttcaccttgtatttctatggttattttcaaccttaagtgtatccctatatagagaacatgtttatctatttggccaccctgtgtctgtctgtgctatttaattttttgtaataacattcttatttgggagggcggaattatatcttcctcactagatacaacctgataagactagtaaatagagtgtcctgtctgtgcctagccaatgaaccctgaatgatatactctgttgtttccacttactagatttggcccattgtttcagcttgccgatcttcagtgtcccaaagtatttcctagtttttccagttactgatttgatcagtaaactttctaatactgcagcaaagtcatgatcaaaatattgaagtagacaagacttccttagtatgtgcacaatacaaatcaagctgttaagtccttactacaaccttgtgaggtagatgttactatcatcttcatttcagataatgaaattgaagcatagagaggttattgtggcccaagtcacatggctaataagtgactgagccaaaattcaaattctgatagttgggctccagaaccctaactggtaatcgttgtactacactgtttccggaatgctccctttaagttgataaccatctattaactgtcactgttcacttgtggtaattaaaccagttacaaatccacctagttatgttatcatctaccactattgaatcgccttatcttcaaggtggttttgccatctgtcctactaaggtccagctagactttttatagatctcgtaactttataaaataaaccatggagatggagttgaaagggggtgctgacaaggaagggagttggagaaggcatctattctcgtgagaaggcctgaagagtgcacaacagcctggccccaagacacaagagcactgggctggcttgaggagcaccaggtgaccaagaccaggcaatgcacagggggaagtcagcaggccccatggagatacgcagctgcagtgtttgtacttttatacagtgaaactcattaccaccttgcttacttcctagtagagagatgtgtcttgtagttacactgaaacacctggctgggcacataggtgaagctgttgagtctgtaattgtcaaactgctcccaggtgccaattataatgtagaagaggcacaagaagatgaagtggataagcctggcagtttgtcaagcattcatcagttgtcaagcatttgtcagttgcagaatgtaggtaggctgccaaggctttattgtagcctggttctattgcagctttattctagcaaggctgctggaaaatacaataatcactggtccaagaaagaactcttatactctatctatatgaagaaacagtaaaagtcaattcagtagaaatcatgatttttgtgcctggtgctttcacttttttatgccacaataccaagaggttaaaatgaagtgtctttgattgggaataccatctatctgggaaaagacagggctgcaacttctgaagaccttgacactctgtcctgttaccctgcttcatttttctcctgcgcttatcactacttgatgctataaacaaataaaaacatatatgatataaggtctatttctcctactcaactgtaagttccatgagggcagggctttctttcttgtttactactctattccctgtatctaaaacagtgcttggcacatagcaagtgctaaaaaatattctttgaatgagtgtatgaatggaacttacagtcagctgaaggagacagttattaagcataagagtgatgaccagtccaattgtgtgtgtcaggcatgtgtgaaaacgtgctaaatttgacttgcttattaggacagtaactgatacttctaatgttcttgcagcccatgacctcttctttaagaagtgtccattctgtactactttcccattattcactcattcattccaaagcatttgctatacagcagtattataccagataccatattaggtgctggggctagagagaatataaaagctaacattgattgagtgtttagtatgcgccaggccctgaactcagcacattacatgtattaactctttaacccctatggcagccctttgagataaaaactaatattatcttcactttacagataagttgagacacagaaagttaggtgactcaaatgggttcactgccttaaggatctcagtctaataaggaaagcagaaaagcaaagcaaccttataatatggtgcaataatttgctataatgaagttatatacaaagtgaagtagaagcatagaagaagcagcactaaatttgtctgggtgagtcagagaaggctaaccaggaaaaatagtttctgaactaacacttgaaggaggtgtagcagttcatcactgacagtgatgttggggtgggtctggtttcaggagaggggaggaaattggctttggtctgaggctgaggtgtgggcaaagcattagcttatgtgggtccattagcttatgtgagtccacaaaaggtgtgtgtgtgtttgtgtgtatgtgtgtgtgtgtgtgtgtgtgtgtgtgtgtacgaaatgggggctcaatgatttggtagtggtttggtttgtcaagaagcaggctgggaactcaataagcatctttccattcatttctactgtgtatcccacagcttcacacacacatgcacatttcaacattggtgactgcttcacttgcacacctaaggtaatgatggacacacctgtagcaatgtagattcttcctaagctaataattagtttcaggaggtagcacatacatttaaaaataggttaaaataaagtgttattttaattggtaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtatgtaattagtcatttaaagggaatgcctgaatactttaaagaattttggcagatttcagatattggacaaacactcttagcttccacaaacttaattccaaaaaataatttttcacttatgagcaatagagttattacggacatatcagcaaaaatgtagtagtgtcaaggctcatagatgatagaaatgaagagatgctgtattgatagaaatatgtgattcaggactgtgtggattgatgattgtgagcttgcttatggatatcctaggtttgaggttatagtaggacaatcaggttgaaatgtccagcaggcagtaggtgaaagacaagtttagggggcaaaaccatggatggagatgaagattcatgacttccacataaaaggatgggtgaaactttgggaattgatgaattctctagaggtgagctcaagacccttaaaggcttaaaacctcagcgttattgtctactcttccctcatttttatgcccacaaatctggtcaatcctttatttgcaatgcctctcacatctctttcttctgtttccatttataccgctgttgccacagcccagggtcccatcacctcacacttgatctattgtattacattcctaactagtcttcccccgtttctaatctgttctccgataaaagctgcacatcattttcaggataatcatcagtcgcctgcctaaaacttttcaatgtcttcccattgtctttagaataaagttcaaagtcttcaaatgaccccaagcaagataacttttgtttgcccctttagatccattttcctgcttctctaccctgcttcttgttctgtgaggtgagcttgtatagaatacatcaacaggttaccttgtcctccagcttttggttggatttcaccaacagggagcactggcaaaagattggcatatttattcttctgactttctccttgcagaggagttcactgtatctccccacttaaggtcactgtttccctcagagtggctttttctacctgtactagctactattgctgtgtaccaagccacttcaaaacttgctgtcataacaataaccattatgttttgctcacagattctgtagatcaagactgggacacagtggggatgggtggtttctggagcctcagttaggattatttaacagctgggtgctggaatcatctggaagttccttctcttgcttttctggtggttggtactgactgtcagctaggacagaatctggggttgttgactgatgtaactttacatggattatccctgaggcctggccttccttacagcatgtttcaaggtagttggacttctttttgagggggggtaggaaggtggggggaggacagagtctcactctgttgcccaggctggagtgcactggtgtgatctcggctcactgcaacctctgcctcccgggctcaagtgattctcctgcctcagcctgctgagtagctgggactacgggctcatgccaccacacccagctaatttttgtatttttagtagagacagggttttgccatgttgaccaggctggtcttgaactcctgacctcaggtgatccgcccacctcagcctcccaaagtgctgggattacaggcacccggcctgtagttggacttcttacacgtcattttagggcctccaagtgtgagtgttacagttaacaaggtgaagactacataaccttttctgaccgagtcttctaagttatgtagcatcacttttgttgacaaaaagtgttgaactctataaaatatttgaagagatttattctgagccaaatatgagtgagtatggcccatgacacagccctcaggaggtcctgagaacatgtgcccaagatggtcagggcacagcttggttttatacattttagagaggcttgagacatcaatcaaatacatttaagaaatacactgatttggtccagaaaggcgggacaactcaacctgggggcttccgggctataggtgaatttaaacattttctggttgacaattggttgagtttgtctgaagacctgggattgatagaaagggaatgttcaggttaagataaacattgtggagaccaaagttcttttgaagtcttatagtggctccccttagagacaatagatgacaaatgttttgtattcagatcttagttaatctctttaggattgggaggggctgggagaaaaagatctagctatgttaatagagattctttacagttgcaaatttccctccacaaagaacagctttgcagggccatttcaaaatatggcaaaaaaacatgttttggggtaaaatattttgattttcttccttgtctcataatgttatgccagagtaaggttggaaagtaaatcatgacatataaggttaaataaaacccatctgatgagaatttatgatttgtagggcatgactccccagaccccttagataggaatttgggcaagataaaaaaaaatcagagtttagtcctcactttcaatacattctattggttataagcaaatcgcatatccacccagattcaaggggaagagacatagaccctaatttttaatgggagaaatgttaaataattggtggtcattttttaaagccactacaataatctatccaattctctctttcaggatgtttctctcttctgatcctttcaggtttagggattgtcaacaaacaaaaagttaaaccctgtaaaatacttgaagagatttattatgagccaaatatgagagaccaatggcctgtgacacagccctcaggagatcctgagaacatgtgctcaaggtggtctggctacaacttggttttacgcattttagggagacataagaccgaaatcaatagatggaagatgtacattcattgagtttggaaaggcaggacaactggaagcgaggcggggcttccaggtcgtaggtagattcaaagattttctgattggcaattggttgaaagagttaagttattgtgtaaagacttagaatcaatagagaggaacatcggggttaagataaggggttgtgaagaccaaggttctgtcatgcagatgaagcctccaggtagcaggcttcagagagaatagattgtaaatgtttcttatcagacttaaagagtctgttctatcagtctgaaggtctgtgttgatgttaatgctggtcagatttttctgaattccaaaagggaggcgggtataataaggcatatttgatccccactttcccatcatggcctgaacgtttttcaggttaactttggaaggccctttgccgaaaggaggggggattagaattttattttgggtttacaggatggtaatactctgttcccaccctcctaactagtatctttattaaaccttccacaaattatcctaatttccatgttttctgttccttgctggatcccttgtttcatacagtaattggtgctagaagaaaccccaggaaacagattttcaaaatgcaattctaaggttatgttgctaatatattcaagaaacacagagataacatatttgccaaggaagaaaatgagcagttagggaatccatgacatgtgttagtattatagtttctcagattatcaccagtgatactatgggatgagttgcagatggcaagtaagacactggggagattaaatgacagtggcatttagtcactgtggcaacaaacgtagcattacctgattgtagagtggtctgtcttcttacagccctagagggcatacacatggaaaaagaaatgaaatgttatgaatatatacaaaataagaacactgatgaacatacatggaaaatcaggatgcatgcatagagcttttgaggaatactccgtatcctgtggttgtaggcagatacgacttaggggctgagcataagttgcagagctgcagtgacaattaaatgcttaactccaccagatctattatgctgtggtaagagtaccggtgggaaggagtgaaactctgaggcctgagatggaggcatttaggcagacatggatgaggctgagaattgcaaacctccaaattcccctgaacctcctttgcctgaggaggcaaccactccccagtctctgaagcagtcatccctcttttgtgtaaaagcctttcagtggctataactgagataggtgcctcacaaaccagtgactattctccttagagaccctgtttggacactacgaaagccaggcgagtcacagaaaatgacagcagatcacaaatttaatcaggtggtgatgccaaaaaacaattgcaattccagatatcatatctctgttgaagcaaatttacacagccccaggcacctgatatggaagtattgacctagagaatgttttttcttcatttccatacattagtaaaatcagaatacatttgaatttaccaagtaggaacaagagtattaagtttactgcccatgcatcagggcaatgttagctctcttgttttctatcataatatagactcaagggacctcaaacatctttacatcccacaagcacaatgcctgtccattacactgatgacattatgctgacaggatctggtaaacacataacaaataagcctgtcttgctcttgactttaatgagaatgtaacctgtgtttcactgtttaatataatgttcactgttagtttcaaatactttttatgatgtttaaaaagttttctcctatccctattttatttgcaatggcaactgaattttatcaaatgcttttccagcatctttgacatggtcacatttctcttttgtgttgtcaaattatacttaacattcaatagtgtgctgacaagaaattaacaacccacaggggagcaaagtgagaagaggttaagaagtaaaggccttgatttatagcattggcagatttccctgacataaatactactcccatcatgcctggccccagggatgggaagagatgcttacttacaattggctctcacagaccagtgcaagagcactactgtgctccatttctgggaaaactttcgtcagtcatagtgtgttagttatttaaaacttagctggatccaatttgccaacatttcatttataatttctatatctatattcatgaatgaaatgggtttagctttttcagtagctctacttaccaggttttggcatgagggttatattaaacttgaaaataaagtgggaaagcttccatttttttccatgaagactattgctctagaatagcttatttaatgtaggaatccagtatttaatgagagtaaatgaaaaagccatatgagccatgtgctttatttagtgagagatactaggctatattttccaatcgttatatgattattgctattctcatttgtgttgccttgagttaatgtctgcaaatgtgcacattagagtcatatatcccttcctgtgccatacatctatatctgtatacacacatatgtcttttctccttttttcccttctgtatcaagagttggcaagtgtttgtctattctattaatttttcaaagaatcagctcagttttaaacccaaacgtggttttgaaagagctgtttctagttcatcaatctctgttcaaaactttaaaaattctattttcctttcttttggtttgtttcctacaatctggaggtgaatgcttagttcacttattcttcaatctttgtattttaacgataaggataaattacttacagttattaactactctcatgaggttcattccttgaacagtcactgagcaactactatgtcctgggttctaattcaggggtgggcaaactatagccccagaatttggcccatagcctgcttttgtacggactgtgagttaagaatagtttttacacgttgaaaggattgcaaagacaaacatacaaagaaacaaagaagactgtgcaacagagaccacctgtggtctgtaaagactaacacatttctatcccgcccttgacagaaagagtctgtgggctgctggtctcctctaacggtggtagagatgcctgcacggttaacattaatccttggcaccagaatcctcagcacctaggaaccagatcttgcctaacacgctaatttcagtcttgaccaccttcctccggcgtagcggttctcaaacgtctttgtctttgtactattcacgtataaaatattctttcataagcaacatttatccttttgggaatacctcacaatggggagaaggggaaccccaacagcctttaagggttcactgcttcgctgccaccatttccgacggtttacactgttttaagtgtgaatttggaattgttttcaagttaaaaagcaaactaatcatgtcctctgaaagtatttgcttttggcatgctagaaatcagtgttgacttttgatactgatgtgatacattacgagggaattctcaaaactgctgaaatctggcctcggcccagttatcactgctcttaagcttctgagggagatacatgaatgagcccacggcaaatggaaaacgaggagttttagtgtttcctagaattatgctcagatacccactacctgaccgtctggttatccttcccctcacctccctgacgcaaggagtttggaccagaggcctaaggaggcttctcctgaagcccaaatcccaaactggtcaccagtcatgctccgtaactcctgaacctgacaagaagccagccggccaggtctgcagcccgggttaagaggagcataccaggaaagagccaaagagcaaaggagcatgagcccttcaaccgcttttacaataatttgggctaggcgttcagggctccgtaggacccttcctggcagccaagtgagagaaagaggaatgatggtggaatgggcctctcctgtgcttcccattacttccacactgtcgaaatagaaatagaagcagaaaagaacaccctacaagtcccacccatttggaggcactcaactcacagtgacaaccctccacacctctcccctgcaaaaagacgcaaaacaaaaacacctactccaaactgtgtccttacatctcagccccgaagatcaggattgtgtgcaacttcggcccaaaggatgcatttccccagggttgaaagtttgagaaagaggctatattctgaagagttcttgttgtcaccatcaaaaggattaaaaagacgcaataaataagaaaacagcgtagttggggggcatgctccatttgagccagaaagccttggaaacttaagtgttctcaaacggaacgccatcctgctttgggggaacacggaggctgccttgcagtcacgtgatcgcacaacaccaaagggccacgcactctgatttcacctacttaactaaaagttgcagcaaaatccctattacaggccaggcgtggtggctcatgcctgtaatcccagcactttgggaggccgaggagggtggatcatttgaggtcaggagttggagaccagcttggccaacatggtgagaccccatctctattaaaaatacaaaaattagcccagcgtggtggtgcacgcctgtaatcccaggcaccctggaggttgaggtaggagaatcgcttgaacccaggaggcggaggttgcagtgagccgagatcacgccactgcgctcctgcctgggcgacagagtgagactccatctcggggggaaaaaaaaaaaaaaaaaaaaaaaaaatccctattacaaataaaagctgttgtgatccagactgcatatacctctgcgaatggaaccagaaccgtgaattccaatgcaaatcgatgcatcggcaccagacccgctgcactggatgtatctgcattgcagtcacccgagtacggagcacatcatagatgatctctgcaggttcgttgcccacataggaggcatagcgcaaatttcaaaggaacgaatacatcctggagcccaaacagctatctggttctgctgctggcctcctgacaagtaggtaagagagtcacattttatagacgacggacaccaaaaccacacatgaggagtacaagagtagctttatcatggatttagggctgtggttacaaggaagctgtaaggaataaaatgactcccatgaagacgtaccgtgcggacgagtggaaggagaaatttggccattacaaagacacaggaatatgttaagaagtgaggggcaggatgaaatcatctagggtaggtatttagagggagggcgccgtgcaaaataaaatcctcactatgaaacaaaggcggaggcaggaggctgcgttaggtggaagcagcggaggaaggagacgaaagggattgtcattttcatgtcgtggctttttagaagacagccatgtcctctactctgattctatcaaaatgtgttctcggggtgctggtaacgttcagccaacgaaataattcctatggcggcagtaggaataacaaaacgcagaagcgggaacgatgtctttttattcctccccagacgcaaacgtggatgcatgaggtttggtaacaggcaaagtcatctggttaacgtgactgatgcaaaaagtccaggcctgggcaaaaagaagtcactgggtgaatgggatggatcagactccctgtcctgagggggagatggtttcttgcagaacgaggtgaaggaggtggttctgctcagcagtcaacagtggccacatctccacctgcagcgacttgatggcttccgtgtccttttcgtgggtagccatgaccaaagactggagcagcagaaagagctcctcgggaagctggccgctgctctcctgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcgggagagggcgccgccgagccggagttcggaggaagcagcgcggccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtagtcgcgcgccagcagctggcaggaggcggcctcgccaagcgcctgcagcgcggccaggggcagctggggcagctggagctgggcggcgcgctggaagtgaccggcggcggcggccggctggcccaggtcgcgcagggcggcggccagctcgaggcagagggcggcggcggcggccggctggcccagctcgaggtgcagacgcaccgcggcgcccagggcgctggcggcggcctgcagcggctccccgtaggcggcggggcagaccaggcgctggcgcgcgtcgcgctcctgccgcaggaagaggcgggcggcctcggtgagggccagcgcctccccgggcccgtggaagagcgcctgctggcagcgcgccaccgccagctggcaccaggccgcgtagggcagacactcctgggcgcgcagctcccggcccagctgtccgaactgctcgccggcctccgccacgttcggcttccgcaggaaccgcttcttcagcttgttcgataccagccggtagcgggccaggaagtccccggcctcgggtcccgggccggcgccgccgccgcccaggcctgcagccgctgccgccatgctcgccgccccaagcacttcccgacgcgccgccgcagctggcgggcgggccggggcggggcgacgtgccctgcgtccccctcggcgggctgccgccgtgcccgcgccggctccccagcccgagcctgccccttgccctgatgaggtgcaaagagcgggatcggaggcggggcctggccgggctgtgagcggcgtatgcaaatcgagggtctcggggatgcggatccaagaccctgggaaggtacgcggggcctggcggggcaccagctgctgctagctcggctgcaatgcaagtggtctaggttgctaaaggcatcccacagcctctccatctgaacatgacccaaacgaaactcgtgaccctaattccatgtctgcgcatttctagactgttgtccccccccccccccgccccgactactcagtcctccgtcttccggtccagggccccttgccaagcaccgggtccacctctccgtccccaccccggttgccttagaagtccgtcctgtcgcaacactgcagtcatggtcttgaggcccacccgccccaacgaacaccatcatgctgaggactttcccgggcaggccctgacttgctcagaaccagcgggggtgtccccttcccacccagggccactcccctgcactgtcacccggagagactgctcctctgtgccatccctggctcccacccaaccccagacccccaccacctctccatccctccagctgtggaggtctcacaaccccccaacccatctcaccgcccccccacccccaccccaaggcaaagtgactgaagcgggcagatggcttccttgaaacattttattgacagaattaatgaaggcccaagactttggggcctgggttgtggggggagggtgtttaaggccgggggttcaggccgggggatttggggccgggtgggtggacgagtggacctgtcaggtcccaggggccgggtgtcagaagctagtcctcgccaggggccacttgagagatggtggtcgtgttgaaaagggtgctcagtagcctgtcgttgtgaaccaccatgtccagcagcaggggagtgatgttccgctctccgctgttctgggcctcgttgcccgccagctccgggaccttggccgtcaggtactcaataaccgcagcgaggtagaccggcgccgtgcgactcaggcgctgagcgtagtggccctcccgtagactgcgctccacctggctcactgaaaacgaaagctccgctcggacggtgcgagagcaggtccgcccccggccgccagcaccggaggaccctcggcgtctcctcctcctcggcatgctgggcgttgagtgtgctatctcggcttggcccagctaggcaagatggctctcaagaggacagttaccgcgtccagtactgtgtatcctagcgaccagggcccagcccctcattggctagggagccgagaccaatgggcacgcacatccggcgacgggcacgcatgtggtgacggcccctcacaagggacacacgtccgtcaggtgacctcatcactttcccattggcctcgagggagcaggcctgggcctagaagtggctggagggccgtgggggtggggtggggcggggcagggggaatcgcgctggtgaccctctctttgccagtgggaactttccctttctactggatgggaacaccgtgggaaagacaaaggggtgggcgaggggaggacgggtaccacgccttcacaatgttgcacatccatcacgaccacctagttccaaaacgttttcaacaccccgaaaagaaaccgaaacccctgtacctataagcagtcacttgccgcacgcctccttccacaccaccactaccagcccccacaccctcccacacacaccccctgcccccgcccatacacacgttcccgatagtccctggcaacccctagtccatctgctttctgtccatagaggttagcctgttctggagatttcctatagatggaattatacgaccaaatgtgaggccgtgtgtgtctggctgctttcacttagcgtaatggtttcatcagggtgcatccatgtagaggcatgaatcactacttccttcctttgaatgactgagtacgattctgttgtatgaataggaggccacattttgtttacccactcgtcagttgatggacaggttatttcccccttctggctattgtgagtggcactgccatgaccatctctctacaggtttttctttgaatatctcttttcagttcttttgggtctatttctagcagtcaaactgctggctcgtgtggtaattctgtttaacttattgaggaaccaccaaactgatttccacagcagctgtaatctttcgcattcccaacagtagtgcatgagagtcccaatttcttcacagcctcatcaaaacctgttttctgtttgcctcattttgttttgtttacagtagccatcctactgggtgtcaagtgctatctcatggtggttttcattcgtatttcccaaatggctaatgatgttgctgtggtttgagtgcatcccccaaattgtgtgtcttggaaacttaatccccaaattcacatgttgattggaggcgcagcctctgagacggtaattaggattagataaggtcatcggggtgagacccccaggatgcgactggtggctttataagaataggaagagaggcctgaaacgacatacacgctcttgccctctcgccgtgtgataccctctgccgtccccagatgccgggtcacttcccagtccccagaacggtaagaaataaatttcttttctttataaattgttcagtgtcgggtattcaattatggcaacagaaaacagactaagacatcttttcatgtgcttcttggccctctgtacctctgctttggaggaatgtctattcaagccctttgcccattttttaattcggttgattgtattttggctgtgggcttctaaaacttattcatatattctggaaaatagactcttatcagatatgtgacttgcaaatgtttctcccattcactttctggatagagccctttgttgcccaaaagatttacatttggatgtagtccaacttgccaaatgaaaagatatctgtggctttgcctttggtgtcatactgaaggagctgttgcctaatccaaggtcgtgcaaagttacatctccgttttcttcttagagttttatagtttcagcccttacatttagatctgtgatccattttgaattaattctttacatgatgtgaggtaggggtccaggggccttcttttgcatgtggctatccagttgtcccagcgcagtttgttgaggggattattcttcccctccacccattgaggggtgccggaactcttactgaaaataaactttacataaatatatgggtttattcctgactctgagttctgtaacattgacctaatgtatcgatcacgatggcagtaccacccttttcggattactgcggttttgtagtacgttttgaaattgggaagtgtgagtccttcaacttttttcttttctgagattgttttggctatctgagccccttacattttcttatgaattttaggatcagcttgtcagtttttacaaagaaggcaggttggattctgacaggcatcacgatgaatctgtatattgccttggagattatgggcatcttaacaatattaagtgtcccaatccgttaacacaaaatgcctttcgatttatttaggtcttctttaatttattttagcaacgtcttgaaattttcagagtatacatcttgtacacctttagttaaatttattcctcgacattttattgtttcgatgctactgtaaaatgaatcatttccttaatcttattttcatgttattcattgctagggtgtagaaatacaaccgactgttgcagattgatcttggatactgcaactttgctgagccgaatatgctttgctgagcatactcagacagggttggcatattagtccgttcctacactgctataaagaactgcctgagaatgggtaattcctaaagaaaagaggtttaattgcctcatggttctgcaggctgtacaaggcttctgcttctgggcaggcctcaggaaacgtgcaatcatggcggaaggcgaaggggaagcaagcaccttcttcacatgttggagcaggaggaagagagagagaacgcacgcaaagggggaagcgctgcacattttcaaacaatcatcagatcttgtgagcgctctatcagaagaatagcaagggggaagtccgcccccatgattcaatcacctcccactaggcccttccttcaacaggtggggattacaattcgacatgagatttgggtggggacacagagccaaaccgtctcagttttttttttttttcttttgttggactctttagtgtcctctatataagaacatgccatctatgcatctatgaatagagatggttttacttgttcctttccgatctggatgccttttatttctttttcttgactaattgccctgactagaactttgagtacgatgttgagttacaagtggcattcctgatcttagggggaaatcaaccagtctttcaccattaagtatgatattatctctgggtttttcatggatgccctctatcaggttgaagaagtttctttctgttcctggtttgttgaatttattttcatgaaagggtactgcgttttgtcaaatgatcctttttgtacatgattaagatgaccatgagccccctcccccgcccccgctccgccatgcattctgttaatatggtgtattatataaattgattttcacatgttgaaccaaccttacatttgtgggataaatcctatttggtcatagtgtataaagagtggtcaataaacatttcgttgaaagaataggagtggatctggcaagcttcttggaggacaatgtgtgtgttaaagaatctgtagcatgatgagaagccaaggcaccggtgggaggaggggagttgcaaccaattcattaaggctggagagtacgatgccagtggagcagtagtggttgatgtggctgggaaagaggtaggcaggagccaagacatggaggttctattatgccatgctcaggttttagaataccctgtaggctacactgaacccactgtggtctttcagcttgggagtgacgtggtctgatttgcctctagaaatatcaccctggaagctgtgtggagaatagaacagagaggattgtgtgtggagaatagaacagagaggactgagattggaattagaaagctgctgtattataccagtcaagaaatgacagatatctcaactaagacaatggcattggtagataagactaggggacagagtccataaaaagtttaggtagtaaaatggcacacagtagacactcactacatattactcatactggtgaacctagctggagacatgataattcatgtgctcattcttcaaaaaatattgaagggtagtgccaggtatactgtgttaagcattgagacaacaccaacgagaaatattctgttgtataaataggccacattttgtttatctactcatcagttgatgaacagttcattaaatgatttccatggcaggggaggtaaatgttgtcctctatcctcttagattctccagctaggacttaaataagatagattaacaaaagaaaagcatacaaaattttatttggcattttttacatgtacatgggagccctcataagaaatacgaagactcaagtgattaattacagctgaatacttacatactagggtgggaaaagtatggtaaattgtgaaaacataacaagacattggggtttgggctaggagagttaattgtggaaaagtcactaagaaggtaagagttgtgtaacaaggttttttggtgcagctttccctcaagcctggactccccatctctggcaataagaatgtgtttcttcttcctggtatacagataatacctttcacatcagagtttcatctcttcctttcatgaaaaaaaaaggaaggtcagtgtgcccttcttgcatctgctactttcaagtgcctttaaacacaaaataatcaatatgccaaagtggcatattttgaggtggcatttgatcccctacattactgattggatagtgtgaatagtgctgccatgaacgctcctgtacaagtgtttgtttgaacagatgttttaaattgcagacgctcctcaacttgggatggtattatatcctgataaacccattgttagttaaaaccattattagtgtaaattcatttaatacagctatattagtccattctcacactgctataaagaactacctgagacttggtaatttatgaagaaaagaggtttaatggactcacagttctgcaggcttaacaggaagcatgactgtgaggcctcaggaaacttacagtcccagcagcaggtaaaggggaagcaagcacgccttaccatggtggagcaggagagacagagagtgaaggacggaaatgtcatacacttttaaaccatcagatctcatgagaactcactcactgtctcaagaacagcaaggggaaatccacccccatgatccaatcacctcccaccaggcctctcctctgacacacggggattacaattcgatgtgagatttgggtggggatacagagccaaaccatatcagcggctaacctaccaatcatcataatttagccaggcctaccttaaacatgctcagaacacttacaattaggctacagttgggcaaaatcatataacgtaaagccaaatttataatgaagtgttgactatctcacgtaatttattcaatattgcactgaaagtgaaaggcagaatggttgtatgtgtactttaagtacttttatgcatatggattctactgaatgcatgttgctttcataccatcataaagtcaaaatattgtaagtccaaccattataagctgggaaccatccatatttgaggtacatacccatgaatatatttatgggtttatttcttgcttcttaattctattccatttatatatatgtctgtccttatgccagtaccacaaagcattgataactgtagctttatacgaagttttgaatttgggaaatgtgagttatccagctttgttattttttaggattattttggctatttgaggtcttgcacaattacacatgaattttaagattggcttttccatttctgccaaaaaaaaaatggccattgggattttgatgcagattgtattaaatctgtagatcactttgggtagtactatcatcttaataatattgtcttccaattcatgaacacaggatatattttcacttctttatgctgtctctaatatctttcagcaatgttttgtagttttcagtgtacaagtcttttacctccttagctgaatttattcctaagtattttattctttttgatgctattttaaatagaattattttttattttgttaatttcatctcagattgttcattgctagtgtgtagaaatacaactgatttttgcacgttgatcttatatcttgcaactttgctgaattcgtttattagctctatagtgttttgtggattcttcggggttttccatacataagctcatgttcatctgagaataagatagctttacttattccttttcaatttggatgccttttatttctttttttcctaattgctctggctaagacttccaatacaattttgaatagaagcagtaaaagcaggcattcttgtctcgtttctaatgttagggaaatatctttcagtcttctaccattgagtgtgatgttagttttgggtattttatgaatgctctttatcatgttgtggattttctcttccatttctagtttgcttagtggtttttttttttttttttttttttggtcatgaaaaggtgctcagctttatcaagtgatttttctgcatcaaccagaatgaacttgcaggggtttttttccctatattttattaatgtggagttgactgggggattgattgtcttatgttgaaccagtcttgcattattgggataatttccacttgagcatgggctataacctttataacatgctgctggatttggtttgctaatattttgttgaagatttttgcacctagatgcataagggaatattatactcacatattcaattacatgcaatttgtaattttcttttcttgtgatatatttgtctggctttgatatcaagatatggtggcctcatagtatgagttgtaaagtttactctccttttctgtctcttggaagagtttaagaaggattaatgttaatccttccttaaacatttagtagaatttaccagtgaggccttctagcacaatgcctggcacataatatatggaatctaggatttgtatagtcagtcattaactatttgttgaattaataaattgtctccccaagcaggtttctaatcaaggcacaaagattgagtaacgaatgaaggcaaagccaatgtatacagggtattagttttctaatgctggggtggcaaattaccacaaacttaatatggcttaaaacaacacaagtttattatcttacagttcgatagggcagaagactgacccaagtcttactgggctaaaatcaaggtgtcatcagggctgcatttctttctggaagctctagaaaaggatcctttttcggtcgcctgtagtcccagctactcgggaggctgaggcaggagaatggcgtgaacccgggaggcggagcttgcagtgagcggagatggcgccactgcactccagcctgggcgacagagtgagactccctctcaaaaaaaaagaaaaagaaaaggatcctttttcctttcttttccagcttctagaggccacacacattcattaactcatggcttccttcctccatcttcgaagccagtaacattgcacctttgtgactattcttaagtagtcacgtctccctttgactctcctcttctgcctctctctctcactttcaaggcctcttgtgattacattgggccgacctggataatccaggatattctccctattttgacatcagctaattggcaaacttaattccatctgcaaccttaaatccctcttgccatgcaacataacacagtcaaatgttctggggattaaaatgtggacatcactgagagatcatattcttcctagcacatacggtttagtcacaagttaatgatcaacatttattagctatataatactcttaagttcaacataaactttttggatgctgataaaacggaatggcattttacattgatatatacttcatttcaaaacttcttctacttctcaatgattattctgtagcaacaaatttcttttaaatcagaaatttggaaacataacgagacctatctcaaatcaaagatgactatccccttttggagtcagactacacattcattattttagtcaaaatgagacataaaattcaggcccccaagagctgccagtacccacttacgcaggaggtagctagacgaaacaggtagctttctacaaatgattttgcaccatcccaccccagagaggtggtttggagtgtttacttattacctgggatttaattatactagctcttgcaaaagccaaatctaaaggccataaatagaaggtcaaattttctcctatatagaaaggagagcagcagagaaaacaaaatccttggtaaatctttaaacaaagttatatggtttgaatatgttattcattctattttaaccccccaatacagatatatttataaaaaagaatattgtgatttctggtataacttgtttaggaacaaagccacaaatttattaatattttctattccctgggaagaaaaaaatgctacatggcagaataattttttaaaatttccagccgggcacggtggcttatgcctgtaatcccagcactttgggaggccgaggtgggcggatcacaaggtcaggagattgagaccatcctggctaacacggtgaaacaccgtctctactaaaaatacaaaacattagctgggtgtggtggtgggcgcctgtagtcccagctactcgggaggctgaggcaagagaatggcgtgaacccgggaggcggagcttgcagtgagccgagatcgcgccacggcactccagcctgggcgacagagcgagactccgtctcaaaaaaaaaaaaaaaaaaaaaattcccatgatactaaactgatgtgtgatcatataatagacttacactgatacctattttagtgtattcaagcagataaaaaatcccaggtgttctatgagtgatatcattttcagtatttcttatgctgtatgccatggtttaaatctaggcctttcgaattggcattactaccatatttctcaaactgtattccctttctcttgaatatgttatgtaattttgtccagaacccagacatgtcaaggtgtcaaatcccacgttttggatactaacgtgtctcattaattcatacagtgggatcattcattaatgcccacattatagactctctctctctctacacacacacacacacacacacacacacacacacacactacattcttagaagatcattctgagaccagggtggaggataggctgtgcattcccagtactctttcacagctgactgtgtcctctgccagtgttttcaaactttactgcttatgaaacagctaagggtcttattaaaatttagattctgattcagtagaactgacatggtgcccaaggaactgcatctcttttaaaaaatctttatttaggtataattgacaaaagttgcatatatttaagaggtacaacttgatgttttgatatattttgtttttcatatatgatgtttgatacattgtgaaatggtcaccacaagcaagctaattaagatatatctatctctttgcctagctacctttttttgtggtgagaacatttatgacctactcttttagcaaatttcaagtatacaatattgtttactatagttactatatcgtacattagatctccagaactaatttatcttgcataattgaaattttgtaccctttgatcaacatctccctgtttcccccacaccacagtccctagcacctaagattctactgtctgcttttatgagtttgaccatcttagattccacatatgaggtcatgaagtatttttctttcagtgtctggcttattacacttagcataatattttccaggttcatccatgttatcacaagtgggaggattttcttctattttaaggccaaataatattttataattgtgggaatattccatcagatatatatatatcagattgtctttatccctccatccatcaatggacacacttaggttgtttccatatcttgactattgtgaatactgttacagtgaacatgggagtgcagatattcaacatactgattttgtatcctttggatatataacagaagtgagattgccagatcacatggtattcatttttagtttttttgaggaacctctatgctgtttttcataatggctgtaccaatttatttttgcagcaacagtgtacaaaggtttccttttctccacattaccaccaacatttgtcatcttttgtctttttgataatagctatttgctatggtttgagtgttttccccaaaaaacatgtgttggaaacttaattcccaatgcgacagtgttgggaggtagggccgaatgggagatgtttaggttatgaggactccaccctcatgaatggattaatgccgattacaaaagcacctaaggctgtgaatttgaattgctctctcttgccctctttttgcccttctgccatgttatgatatagaaagaaggcctttgccagatgctggcctcttgatcttggactgcccagcctccagaactgtgagccaaatacatttctgttcactacaaattactcagtctgtggtattctgtcatagcagcataataaattagagtccataataagttatagtccataacagactaagacactattctaatagatgtgagggaatatctcattgtgttttgatttgcatttccctgtgggttagtgatgctgagcatcatttatctgttggccttttatatttcttcttttgaaaaattctatttgggttctttgcccatttttaattgggttgtttcttactaatgagttgtttgagtttcttacccattatcagatatacagtttgcaaatattttcatccattccataggttgtcttttcactctgttgattatttcttttgctgtgcagaaagtttttagtttaatgcaatcccagtttctatttttgtttttgttgcctgtgcttttggtgtcatataaaaaaattattgcccaaatcaatatcaggtagcttttttcctgttttcttctaggagttttatagtttcaggtcttatatacaagtgtttaatcaattttgagttgaattttatgtatagtgtgagaaaagggcccaatttctttcttctgcatgtggatattcagttttcccaatatcatttattgaagagactctcttttccccgttgtgtgttcttggcacccttgtcaaaaatctgttgactgtaaatgtgtgaacttatttctgggcttttctattctgttcccttggttgatgtgtctatttttatgccagtaccatactattttgattactggagacttgtagtatattttgaaatcaggaagtatgatgcctctagctttgttcttcttgcttaagattgctttgccaggctgcatgtggtggcccacgcctgtaatcccagcactttgggaggctgaggtgggtggatcacttgaggtcagaagtttaagagcagcctggccaacatggtgaaaccccgtctctactgaaaaaatacaaaaattagccaggtgtggtagcaggcccctgtgatcccagctaatctggaggctgaggtggagaatcacttaaacctgggaggcagaggttgtagtgagccaagatcgcaccactgcactccagcctgggcaacagagcaagactctgtctcaaaaaaaaaaaaaaaagattgctttgcctccttggggtcttttgtgatttcatattaattaaaattttttttttatttctgtgaagaacaccattgagattttgatagggatcacatcaaatctatagattactttgggtagtgtggacattttaacaatactaattcttccaatctaggaatatggaatatcttttatttatctgtgtcttctttaatttccttcataaatgttttctatattttcattgtacaagtctttcatttctttggttaagtctattcctaagtattttattcttttgttgctattgtaaataagattattttctaatttcctttgggatattttatagtgtatagaaacaccactgatttctgtatgttgattttgtatcctgcaactttacagaattcatgtattagttctaacaatttttttttgagtctttagagttttctacatgtatgatcatgtcatctgcaaaaagagataattttactattctcttctatttggatgctttttattttatttattttttaaattatattttaagttctgggttacatgagcagaacatgcagttttgttacataggtatacacgtgccctggtggtttgctgcacccatcaacccgtcacctacattaggtatttctcctaatgttatccctcccctagccccccaccccccaacaggccccagcgtgtgatgttccactccctgtttccatgtgttctcattgttcagctcccacttatgagtgagaacatgcagtgtttggttttctgatcttgtgatagtttttgagaatgatggtttccagcttcatccatgtccctgcaaaggacaggaactcatccttttttatggctgtatagtattccatggtgtatatgtgctacattttcttaatccagtctatcattgatggacatttgggttggttccaagtcttcgctattgtgaatagtgccacagtaaacatacatgtgcatgtgtctttattgtagaatgatttataatcctttgggtatatgcccagtagtgggatttgctgggtcaaatggtatttctagttctagatccttgaggaatcgccatactgtcttccacaatggttgaattaatttacactcccatcaacagtgtaaaagcgttcctatttttccacaacctctccagcatctgttgtttcctgactttttaatgatcaccgttctaactggcgtgagttggtatctcattgtggttttgatttgcatttctttaatgaccagtgatgatcagcattttttcaaatgtctgttggctgcataaatgtcttcttttgagaagtgtctgttcatatcctttgcccattttttgatggggttgtttgtttttttcttgtaaatttgtttaagttctttgtagattctggatattagccctttctcagatggatagattgcaaaaattttctcccatcctgtaggttgcctgctcaccctgatgatagtttcttttgctgtgcagaagctctttagtttaattagatctcctttgtcaattttggcttttgttgccattgcttttggtgttttagacatgaagtctttgcccatgcctatctcctgaatggtattgcccaggttttcttctaggatttttatggtcctaggtcttacgtttaagtatttgatccatcttgagttgatttttgtaaaaggtgtaaggaagggatccagtttcagttttctgcatatggctagccagttttcccaacaccatttattaaatagggaatcttttccccattgcttgtttgtgtcaggtttgtcaaagatcatatggttgtaactgtgtggtgttatttctgaggcctccattctgttccattggtctgcatatctgtttggccccagtaccatgctgttttggttactgtagccttgtagtatagtttcaagtcaggtagcatgatgcctccagctttgtccttcttgtccaggattgtcttggctatgagggctctttgttggttccatatgaagtttaaagtagtgttttccaattctgtgaagaaagtcagtggtagcttgatggagatggcattgaatctataaattactttgggcagtatggccattttcatgataatgattcttcctatccatgagcatggaatgtttttccatttgtttgtgtcctctcttatttccttgatcagtggtttatagttttccttgaagaggtccttcacatctcttataagttgtattcgtaggtattttattttcttagtagcaattgtgaatgggagttcactcatgatttggctctctgtttgtctgttattggtgtataggaatgcttgtgatttttgtacattgattttgtaccctgagactttactgaagttgcttatcagcttaaggaggttttgggctgagatgatggggttttctaaatatacaatcatgtcatctgcaaagagagacaatttgacttcctcttttcctatttgaataccctttattgctttctcttgcctgattgccctggccagaacttccaatactatgttgaataggagtggtgagagagggcatccctgtcttgtgccagttttcaaagggaatgcttccagtttttgcccattcagtatgatattggctgtgcgtttgtcataaatagctcttattattttgagatatgttccaccgatacatagtttattgagagtttttagcatgaaggggtgttgaattttatcgaaggccttttctgcatctattgagataatcatgtggtttttgtcattggttctgtttatgtgatggattatgtttattgatttgcatatgttgaaccagccttgcatcccagggatgaagccaacttgattgtggtagataagctttttgatgtgctgctggatttggtttgccagtgttttattgaggatttttgtatcgatgttcatcagggatattggcctgaaattttctttttttgttgtgtctctgtcaggttttggtatcaggatgatgctggcttcataaaatgagttagggaggattccctctttttctattgtttggaatagtttcagaaggaatggtaccagctcctctttgtgcctctggtagaatttgtctgtgaatccgtctggtcctgtactttttttggttggtaggctattaattactgcctcaatttcagaacttgttataggtctattcagggattcaacttcttcctggcttagacttgggagggtgtatgtgtccaggaatttatctatttcttctagattttctagtttatctgcatagacgtgtttatagtattctctgatggtagtttgtatttctgtgggatcagtggtgatatccccaatatcattttttattgcatctatttgattcttctctcttttcctctttattagtgtggctagaagtctatctattttgttgattttttcaaaaaaaccagctcctggattcaatgattttttgaaggtttttttgtgtctctatctccttcagttctgctctgatcttagttatttcctgtcttctgctagcttttgaatttgtttgctgttgcttctctaattctttaattttgatgttagggtgtcaattttcaatttttcttgctttctcttgtgggcatttagtgctgtaaatttccctctaaacactgctttaagtgtgtcccagaaattctggtacgctgtgtcttcattctcattggtttcaaagaacatctttatatctgccttcatttcattatttacccagtagtcattcaggagcaggttgttcagtttccatgtatttttgtggttttgagtgtgtttcttaatcctgagttctaatttgattgcactgtggtctgagagactgtttgttatgatttccattcttttgtatttgctgaggagtgttttacttcgaattatgtaatcagttttagaataagtgtaatgtggtgctgagaagaatgtataatctgttgatttggggtggagagttctgtagatctctattaggtctgcttggtccagagctgagttcaagtcctgaatatccttgttaattttctgtctcattaatctaatattgacagtggggtgttaaagtatcccactattattgtgtgggagtctacgtctctttgtatgtctctaagaacttgctttatgaatctgggtgctcctgtattgggtgcatatgtatttaggatagttagctcttcttgctgcatttttccctttaccattatgtgatgctcttctttgtctcttttggtctttgttggtttaaagtctgttttatcagagattaggattgcaactcttgcttttttttttgctttccatttgcttggtaaatattcctccatccctttattttgagcctatgtgtgtctttgcaagtgagatgagtctcctgaatacagcatactgatgggtcttgactctttatccaatttgccagtctgtgtcttttaattggggtatttagcccatttacatttaaggttaatattgttatgtgtgaatttgatcctgtcattatgatgctagctggttgttttgcccattagttaatgcagtttcttcatagtgtcaatgttctttacaatttggtatgtttttgcagtggctagtaccagttgttcctttccatgtttagtgcttctttcaggagctcttgtaaggcaggtctgatggtgacaaaatccctcagcattcggttgtctgtaaagaatttcatttctccttcacttatgaagctttaagaggtttaattgactcacagttctgcatggctgtcccataagtcccatgttctttcctcaggaaacctacagtcatagcagaaagggaaataggcacatcttacatggcagcaggcaagagagagtgtgtgaaggaggaactgtcaaacacttataaaaccatcagctctcataagaactcactatcaggagaacagcgtgggggaaaccatccccatgatccaatcacctcccactaggtccctcccttgacatgtgggcattatggggattacgattcaaggtgagatttgagtgggaacatagagccaaaccatatcagtatctaaaaggaaaaaccttcagtttttccacatttggttatgatatcagctgtgagcttttcctatatggtctttattgtgttaagttccttctgtatctatcttgctgaaagtttttattatgaatggatatctagttttgtcaaattctttttctgtattgatcgaaataatcatgtgtttttcatctttcattctgataatgtggtatatcacattgattgatttgcccatgttgaaccatccttgcatcctagggataaataccacttgttcatgatgaatgatccttttaatgtgctgttgaatttggttggctggtgttttgttgaggatttttgtatccgtgttcatcagggatattggcctgtagttttctttcttttcttttcattttctttttctttctttttttttttttttttttttgagacagagtcttgctctgtcacccaggctggagtgcagtggtggtatgatcttggctcactacaacctccacctcctggattcaagcgattctcctgcctcagcctcctgagtagctgggactactggaacatgccatcacacccagctaatttttgtatttttttagtagagatgagttttcaccttgttggccaggctggtctcgaattcctgacctcaagtgatttgcctgcttcagcctcccaaagtgttgggattacaggcttgagccaccacacctggcctggcctgtagttttcttttctagtgttgtttttgcctggatatggtatcagggtgatgttggctaataaattgtattttgaagtgttctctcttgtattttttggaagagtttaagaaatactggtattaatacttcgttgaatgtttgatggaattcatccatgaagccattggtcctgggcttttctttgttggaaggtttttgattactagatttaatatccctatttgttgttagtctgttaaggctttctatttctttgttattcagttttggtatgttatatgtttctaggaatttatccatttcctctaggttaaccaatttgttgacacttataatagtcccttatggttctgtctgtttctgtgacatcagttgtagtgtctcctctttcatttatattttatttatatgagtcttctctctttttttcgtagtctagataaggacttgtcaattttgtttattttttcaaaaaaatcaactcttagttttgtcagttatttccaattgtttttttattctcttttttatttatttctgctctagcatttattatctcctttgttctgctacctttgggcttagttttttttttcttctttttgtagttcctggaggtgataagttgggttgtttatttcatatgtttcttctttttaaatataggcatttattgctataaatttccctattagtatgcttttactgcatcctttaagttttggtatattatcaagattttggtttcttctgtgacccaatggtcgttcaagaatgtgttgtttagtttccacatatttgtgaattttcgtgttttcttattgttattgatttgtagtttcaatccattgtggtcagaaaatatacttggtatgatattaatcttcttaaatttattatgacttgttttgtgacctgaaaggtgatctgtcctgaagaatgttttgtgtgtgcttgataattctactgttgggtggaaagttctgtatatacattttaggtccattgggtctattttattcttcagttctgttttgtccttattgattttctgttgggatgatctattcattatagagagtggagtattgaagtcaactatattatattgttatctatttctccttccatgtctgtcaatgtttgctttatatatttaggtactttcgtgttgggtacatatatatttataattattacatcttcctgttcaagtgacccttttattatataatgaccttctatgtctcatgtcacagttttttacttaaagactattttttctcatacaagtatagccacccctgctctcttttggttacagtttgcatggcataactttctccaccccttcactttcagcctatgtatgtccttaaatcaaaagtgagtctgttatcaacaacatgtagttgggtcctgtttatttttgtttcttacttcccatctctgaattgttggctttttaaaaagcccattcagttactctgtgtcttttgactggggagtttagtcaatttacacttaaagtaattattgataggttaggactttctgttgccattctgttaatagttttctgttttgtagttttcttgttcctttcctctttttctttctttgtggtttgatgatttttgcttggatgtgttttgattcttttctctttatcttctgtatatctactgtgtgggggggcggtcgggggggttaccacagggatcaaattgaacactttatagttatggcagtctgttttaagctgacaacaccttcaatcacatacagaaactctatactttactcattccccccgccacaactttatgtaatcgacgtcatattttacttccttctatattgtgtttccattgacaaatttctgtcactatagttactattactatttttgtcttttaatttataaattaatattaatagtgatttataacaatcattatagtgttacaatagtctatgtttctctttatatttacctttagcagtgaaaggattcatatgcttttgtgttactgttttttttttatttcaacttgaagaactattagcacttcttataaggcaggtctcatggtgacaaaccccctcagtttttgtttgagaaaggctttatctttgtgttcattcttaaaggacagtttttccagataaagtattgttgattggatttttttctctcagtactttgaatatatcatcccactctttcctgacctgcaaggtttctgctgagatatccactcatagtcttatggagctcccctataggtgacaattcactttcttcttactaccccaaaattctcttttgtctttgttgaaaatttaattataatgcatctcactgtagacttctgtgggtttaatgtatttggttatctttgggcttaatgaatccagatggcacttcccctccatagatttggggagttctcacctattatttctttaaataagtttcctttctctctctcttctccttttaagatttctataatgcatctatcattttgcttgatgatgtcccataagtcctctgttcttccttcactctttctcattgttctttttattccgctaactagataatttcaaatgacttgtcttcaagtttacaaattctttcttctgaatgattgagtctgctattaaagatcgctattaaattttttagttcagtcattcttcagctatattcagcaatattctttagctacaggatttttatttggttcttttttatggtttttatttctttattaaacttctaatgttgttcatgtattgttttcctcattttgttagtcgtcttcctgtatcctcttgtagctaattgagcttctttaaatgattattttgaattctttgtcaaaaatttcatgaatctccatttcttcagggttggttactggagctttattagttccctttggtgatgtcatatttgcctgattcttcatgatccacatagcctagcattggtatctgtgcattggagtgagctgacacctcttctggtctgaagttgggtactcagacaatgggcccattaccagggctttggataggtgtagctctcactgggtccttgagtgggcaggactgcctgcagaccatgatgcagtgggcctggagctgggtcaaagggctgcttcagggtccccacttgggcccacagtcagtgggcctgttatgggggcacaggtaagtgtggattcaggcaggactgtctccagaacatggtacagcaagactggagttggctcacagggttacttctgagtccacagtcaggtctagttggtgggcctgcttccagaggtggactggcatgactcccacctgtttcctaagtaggcaaaacttccccaagaccatggtagtgtggtactgaagctgctttaggtacagggctgcttcagagtccacagttgggagccctgttactggggttgccaatgggagttgctcctcccagattcctgggcagatagggatagtggtaggaccacatacaaacaactctggagctaagtccccagggtggtgggctgcttctgggtccacaaccagaactacagttgacaggcctgccgctagaatgtgggcctgccttattaaagtattcatctttgttcttgagctctaccagggtttctcaacctcctacctgaatcccaaggctcccacaaagacacttttgtccatagatcattgtcaaattattgttcctgtgggggaacaagagctagggacctcctatcccatcaactcactgataccgttctcctgatgctgcattttgaattgccctcaggtgatgctgctactcctggtctgtggaccatgctggagtagcagagcccaaatggcttcctcaacttttatgagccttttacaggaactcaaagtagaaaataacttcacttgccccagacctaataatttcctttgttcccacttcttcttggtgctttcctcctttgtgtctaccatcgtaacatccatctaaccatagttgtcttatgtagatgttggatgctgttgagaaacgcacaaagcaaattagaaggaagatatgattgacagaaattgctttttactctgtattcactttccatgtatttgtgctaatctctccatacaggtcttctttggcaatgtggattcatctgggataaaacacaatatttttaaccctccaattattgctcgatacatccgtttgcacccaactcattatagcattcgcagcactcttcgcatggagttgatgggctgtgatttaaatagtaagtgccaagtcatcccatatccttcttccctcaaccatgggtagggtgactaactgttctagttatcctgagactgggggaggggttcccggtatcaggacacaaaattgtcagtgctaaaaccagcatagtcctgggcaaacccagaaataccattcaacccagcagtcccatcactgggtatataatcaaaggaatataaatcattctgtcataaagacacatgcacgcatatgttcatttcagcactattcacaatagcaaaggcatggagtcaacctaaatgcccatcaacaacagattggataaagaaaatgtggtacatacataccatggaatactatgcagccataaaaaagaatgagatcatgtccttttcagcaacatagatgcagctagaggccattatcataaatgaactaatgcaggaacagaaaaccaaatatcatgtgttctcataagtgggagctaaacattaaatgcacatggacacaatgatggacactcaggaggggagaggttgggaggggggtgtgggttagaaggttatgtattgtgtactgcactcactacctgagtgaggggatcattcatacaccaagcctcagtgacatgcaatttacccatgcaacaaacctacccatgtacccctagaatctaaaataaaagtagaagaagaaaagaaacaaagaaaattaaagagtcacacaaagtgggaagagctggctggaaaacagatagcaataacagaattggccgggcgtggtggctcacacctgtaatcccagcactttgtgaggccaaggcgggtggatcacgaggtcaggagatcaagaccatcctggctaacatagtgaaaccccaactctactaaaaatacaaaaaattagccgggtgtggtggtgtgcgcctgtagtcccagctactcgggaggctgaggcaagagaatcgcttgaactcgggaggcagaggttgcagtgagctgagatcatgccactacactccagcctgggtgacaaagcgagactccatctcaaaaaaacaaaaacaaaacaaaacaaaacaaaaaaccaataacagaatctgtgcaaaagttaaaacctgagaaatgatattatgatgacagtagccctagaatatcagtggaagctgctcagtataactgaggctgaagcatgtccttgtgataaccttcttttttcttttctttgaggttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtaagaggcaacagatttactgtttaactgactcagagcagtggttggggaaaaaatcggggaaggccttgactgtttcttctgaggtatttctgtcaactgttagttctaaaaagtgtgtcaaggaagtttggttatgggcagacaaccacacaggcatttgggggaaatgatctctaattgaacctcctggaagaagaatctctatatctagtactgagctaatatctgtcaaagaattgtagaagctaaagtccattttacagataaatatcaacaattagctttctttccaggtttctcattacatcaatgaaaagtaaacatttactgcacatcttagtatccctaggatgagcctagggatacaaaggtgaattgtgaaaaattttggccctgaagttgcttagagttgaataagagagactgactagccaatagaaagtggaggctgggtgcggtggctcatgcctgtaatcccagcactttgggaggctgaggcgggccgatcacaaggtcaggagttctagatcactcttttgctgaggcaggataatcgcatgaacctgggaggcggaggttgcagtgagctgagatcatgctattgcactccagcccaggcaacagtgcctgactctgtctgaaagaggcagagagagagagagagagaaagaaaggaaagaaggaaggaagaaaaagaaagaaaggaaggaaggaaggaggccgggcagagtggctcacgcctgtaatcctagcactttgggaggcctaggtggcagatcacctgaagtcaggagttcaagaccagcctggccaacctggtgaaacctcatctctactaaaaatataaaattatctggacatggtggtgggcacctgtaaccacagctactcgggaagctgaggcaggagaatcggttgaactcgggaggcagaggttcagtgagctgagatcatgccattgcactacagcctgggtgacagagcaagactccgtctcaaaaaagaaagtagagtgagaagtgctgtggtatggttaagagggatttgggaatttctgggagtaaatggtgaccaagaggctactagtccaactctattgccctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtaagctggtctccttggaaagaaagaaagaaagaaaaaaaataccacctctcctagagcttaacataacataaaaaggttgatatatgaccaaattttcagagcaaaatttattaagtacctatggtagcaagacattgtaaaaggcattctgagagaacacagtgactttaagaaaaaggtaaaatactgagaaaagggcagagtagatccaagagttaattctcctcatcagcaccttgattcccaagcctttttgacctttaagtttagtggtccaggaagtcttcattcttaatctgggtttgctggataattcaacaaattgtcctgattaaaagacatgacataaagtcttatcaccccatgagtaatgggggaaggaatagttcctctctttggtattttttatattcttttttcaccaagaattaaccatgatgtggtccttaccaatctctctaatacagtctcttgccacttggctctttaagctccatccatactaagaaattctcaggtcactaaatacagccattatatctcataccaggcttttaaatagatactatttcttctacctggaacatttttctagctaccctctactgccactttcacctgactcattcgttaagtctcaggtaaacatcatgtccaagaagaattcccttatccatcaaggctggatgaaagacttcaccaaactggcagtttggtgaactgaagtctagacattggatattctagaagaaaaattcccatttaaaaaaggttatatctctgattagtgccacaacatgatgaactttcaaaatatgctaagtgaaggccgggcgcggtggctgatgcctgtaatcccagcactttgggaggctgaggcaggcagatcacgaggtcggtaaattgagaccatcctggctaacacagtgaaaccccatctctactaaaaatacaaaaaattagccaagcgtggtggcgggtgcctgtagtcccagctactcgggaggctgagacaggagaatggcatgaacccgggaggcagagcttgcagtgagccgagatcgcaccactgcattccaacctgggcaacagagtgagactccatctcaaaaaaaaaaaaaaaagaaaatacgctaagtgaataggccagacataaaaggatagatattatatgattctacttatatgagtgtgttagtcagggatatccaaagaaatagaaccaataggagattctgtctgtctgtctctctctctctgtctctctggatgagctaaactgttttagttcaagactgaaagcaggaaaaagctgatgttccagtccaaaggcagacaggcagcaagaatactttcttacttggggaagactcagtctttttgttctattcaggccttcaactaattggatgatgcctcccacattagggagagcaatctgctttactcagtctactgacttcgatgttaatcccattcaaaaacaccttcacagaaataaccagaataatgtttgagtaaatatctgggcaccttatgaccaagtaaagtagatacataaaattaaccatgacaagtccaccccttgtcaatgtagcacccatcatacacatctcctttatctctaagtagagacaaaaatgaggtcataattccacctaacatgatataacaaaacttggctggtattgataactaccttcttctactacccattctgtattgactttgccttcagcaagcatctcagctgattgtggttctttacctgatgaggtgacccaaacctttattcctgaagagcctgggccactagtagtcctgcatggattgggttgctgtagtttcccattgaccagaatcatagggcctggtaatactaagagacactctaagggatctattgtattccagacacactcttccatacctccattgtgaagcagtagttcagtttccttccaggaaggacaaaacgctgccccttccatgatgaacatattccaatgtaatcaacctgctgccagatagctggctgatcatcctgggaaatactgccatactgaggactctgtgtttgtctctactgctggcagattgggcacttagcagtggccatagccaggtcagccttgttgaatagaagtccatgttgctgagcccatgcatagcctctatccctgccaccatggctactttgttcatgagcccatcaggcagtgacataggtggctgagtaaaaaggatgactggtatccacagaacaggtcatcatatctactttttttttgagatggagtcttgctctgttgcccaggctggagtgcagtggcacaatctcagctcactgcaacctctgcctcccaggttcaagcatttctcgtgcctcagcctcccgagtagctgggactacaggcacgcatcaccatgcctggctaatttttgtatttttagtagagacagggtttcaccatgttggccaggctggtcttgaactcctgacttcaggtgatcctcccgccttggcttcccaaagtgctgggattacaggcgtgagccactgcacccggcccatcatatttacttgattattgaaatccttatctgctgaggtcacccttcgttgagcactcacatgggacataaatatattcacatcctttgcccattcagagagatctgtccacatacctcttccccaaatttctttgtcacctgttttctaatcatgttccttccaagtccctatctggacaaagcactgactacagcccattacttgacatataattgcacacctggccatttctccttctaagcaaagtccacaaccaggtacactgcctaaaattctgcccactgtccttcatgggtatctcagatcgggactgtccacttttgtgtagtacctgcatatcgtgcagaaccgtctgtaaaccaggcccaagactcctcttcctctgtaaactgatcatagggaactcccaatggggccataagtgcaggctgggagagagaaggcagggtagcagaaacaggcaccatggacatttgggctacttcttcatgtaatttacatgtgttttcagtacctgctcagacatgatcatgtatataccacttccatttgatgatggagtgccattgttcatacccaactttatggcttggtgggtcagataacacctagttcatgatgggcagttcaggtcacatggcaacttggtggtctgtggctaagcattcagtatctactaaggcccagtagtaggccaagagctatctcacaaaaggagaacagttattcacagaggattacaggaggatttctcactacagtagcccctgctccataggtcagggaaccaatgtgaagatcctgctagctgctcaatatatctgttccaattacgcattccaggactggggaaataaccacaagatagtctcacagatcctctgcatccactttgagatggacttgagctaaaattccattgatcatttgaccctccataagcccatactctgactggtggaccacagtgacattttgggtctcctgaaattagtgccagttcagagccattgtccagtagtccctgaaaggtctgattaattatttttcttcagtgcacatttattctgatagaaaggccatatgtccctttggggaaggctgagagaaagagtggcagtattcttggcagtgtaccagagtccttcctcaaggagactgagcctccccttcattcaaggagtgctgggtctgtaaacctgctcaagtctgggaattgattgagaggccgtgactctgtttttattattcaggttagacttttgttcacttgacctagaacttttccacttatgcagttcaagaatttggtaggcattctatctatatcacatctaggaacactataatctactagccaacaccataggtctgtgcaagtcatactattctaactgctgctttgactctgctgtcccttatggtaaccacacttaccttgcctttggcagttgagtgctgcccattggccccttccaccccaggatccaattattcccattgtatttaggttttctaattcagtgactgcaggtcctgctgtaaggtgtcacctacagagaagagtgatcacagagcccttcaaggatgctgaggttcccctcacaaatttattcctcaaagtaatagtgagatctgtgtcttctgaactctcccagtgttggtgagtatgtcttaaatgacaaattcactctagcatttcaatctcctttcttctacattaaaccagggcaagtctgaaatttctagtttgctcactgtgggccatcttttggtctgtgtttcagccaaccaattaaactgttagaggccttcctaattccctgagatgcaacattaagtccagaatctctgcttagtgggcccatgtcaataaatttggcctaatccaactttacgtgccttccaccgttatctcacatccttagtacccattcctatacatattctctggattcctgcttgtgtaaattagaaaactcaagtcatgattttggagtgtagtgcaccttgtcatgggtcaccttcatacctcacctcgcctgctgggacttgagtgtagttatagatctaataacaaagaggggtggtagggtgggtcctgaaggaatcagcattatcttgcatggcagttgcctcaggggaagccattacagtttcctcaggcagtgcagggttaatccacttagactggagtagagatactgccaccacagggctggagagaaaactttcactgacaaagaagactcatcaatatttaggagctcaatgtccccagcttaatcagggtcttccacacatacctaatccaacttgtagtgccccattctttcccaatcactgcccttgctttaacagtagacaccctgcaaagctgggagtttggcttgctttgtaattcagttagtcacaggatgagatttggcatttgattttcagcaatctcagctctgtggctacagtagataagggtctccttcagggcatacatagaatctgtcaagtcatttatgcagctcttgagctgggaattcaaattcctgagctcctccttttctttcatcactttttccagcaacattaggagcaaccgactaatcccatcatattcattagtttgacaaatatgttcacaagtgtcaatatacatagtcaccaagacccttgcttcttaaaagtagttgattaggagtatccaatggagatattttgcatatacatattttttgagatggagtctcgctctgtcacccaggccggagtgcagtggcatgatctcagctcactgcaacctccatctcccaggttcaagcgattatcatgcctcagcctcccgagtagttgggattacaggcacctgcctaatttttgtgtttttagtagagacagggtttcatcatgttggccaggctggtctcgaactcctgacctcaggtgatccatccacctcggcctcccaaagtgctgggattacaggcgtgagccaccgcgcccagcctggcctacatatttctattgccagatcatgccatggacaatttttactactgaaaatagtcattagtgtctttaaatttcatcaggttacagaaccaattccagaaatccaataacaaatttataaaatttatccttaaaattctgttcctttagaatcactcttggtgtgaaaatctgtattagtcatggttcccaaagaaacaaaaccagaaccaagaggagatacatacacacacacacacacacacacacacacaaggaattagctcatgtgattatggagtctgccaagtctcaagatctgcagggtgagttggcagcctagagaccccagagagctgattcgtagttccagttcaaagaccagcaggctacagacccagaaagagttaaaatgttttagttcgagcccaaaggcaggaaaaaaactgaagtcccagtttaaaggtagtcaaatagaaggaactgtctcttactaagaggacagtaagcctttttgttatatttaggccttcaactgattggataagttctacccacactggggagaacaatctgctttacttagtctaccaattcaaatgttaatctcaccaaaaaacactctcacagacacacataaaataaagtttaatcaaatatatgggcaccccatggcccagtcaagttgacacataaaattaaccaccataatgaggtatctagagcaggcaaattcataaagacagaaagtagaaaagaggttaccagggtcttggaatggggaagaaatggagagttatttttaatgagtacagagtttctgtttggggtgatgaaaaagttctggaaatggatagtggtaatgggtgcacaatattgtgagtatacttaataccactaaattgtacacttaaaaatgattaaaatggtaaattttatgtatattgtacaacaataaaaaaggctatatcactgacaatgcattgttgtatttagcaaagaaaggggaatctccagcctccccatcaacaaaaacccccacaaacttctattttaaaataatgagctgaaatcatagcggagaggtgaataatgagcaaatataaaaaggaagacctttcctcagacagaatgcccatattaatgttgttactggaagactaagccttgagcaaaatgcaaggagaactcagtgtgagaattctgcattgtcatgaatcccagaaggaagctagagaagttgcagataaatattatcctctggcacctggaagaaccattctcaacctactctagaaaaaaagcacctccagtttaggcctccaggattcctacatattaaaattataagatcacagacatagatcagcaaacatgcaagacaacaagacaacttgagtacaagtgaacagaaacaatcaattcagatttaaaacttgaagaacaccagatattgacattatcggatacataatatgaaataattatgtataaaatctttaaagtaataacatatggaaacatgaaaataaaagacaaattatccaacattattaggcagttgaaaaaaaccattgcaggttacaaagtcaacatgcaaaaatcaattgtatttttatatactaacaattacaaatatgaaaaggaaaacagaaaagtctatttacaatagcatcaaagataatacaatatttaggaataaatttaacgaaggaggtgcaagtcttgtccactaaaaacaaaaaaacccagttgaaagaaactaaagaactgtctggtctgaagacagcaaatatggaaaattagcaactagaaaaaaattaaaaattaaaaattaaaagagaaattaaataactaaataaatgaaaaggcatcctggatttatggatttgaagacataatattcttaagataagaatattaccacaaaccatttgcagattcaaagcaagcattctgggtttttttgtttgtttgtttgttttttgatttgagacggagtctcactctgtcgctcaggctgcagtgtggtggtgcaatctccactcaccataacctctgcttcctgggctcaagcgattctccggcctcaaagcattctctatcagaatcccaaagacatttttttttttgaggaatagaaaaatctatcctaaaattcagatggaatttcaagggaccctgaatagccaaaacaatcttgaaaaagaacaacgttggaggagtcatacttcccaatttcagaacttactacaaagctacaagaatcaaaacagggcagtacttacataaatatagacacatagatcaatggaatagaattgagagtccagaaataagcctatacatctatggtcaattgattttcaataaaagtgccaagaccattttgtgggaaaagaatagtctcttcaacaaatggtgctgggacaattggatatccacatgcaaaagaatgaagttggatctttaccatatacaaaatttaactcaaggctggatgtggtggctcacatctgtaatcccagcactttgggaggctaaggctggtggatcacttgagctcaggagtttgagaccagcctgggcaacacagtgagactctgtatctacaaaacaagaaaaaaaaattagctggcatgatggtacacacctgtagtcccagctactagggaagctgggataggaggatcgcttgagcccaggaggtggaggctgcagtgagccatgatcgcaccactgcactccagcctgggtgtcagagcaagaccctgtctgtaaaaaatcatttaactaaaaatgtatcaaaaaactaaatataaaagctaaaaccataaaactgtaagaaaaaacaaagaggtaaattgttatgatactggatttggcaatggtttcttagatgtgacaccacaatcacaagcaacaactctataaaaatatatatagtaggcatctttaaagttaaaagcttttgtacatcaaagaacactatcaagaaagtaaaaagatgatctacagtataggagaaaaaaattgcaaatcatatatctgataaagggcctagtatcccagaatataaaaagaactcttacaactcaacaacagaaagacaaccaaattttaaaatgggtaaaggacttcaatggaacttctccaaagaagatatacaaggatccaacaaactcatgaaaagatagacaacatcattagttattagggaaatgcaaatcaaaaccacaatgagatagcatttcaaacctgctaggatggctaaattaaaaaaaaaacaaaaacaaaatgtcaagcgggaaaataacaagtgttagcaagaatataaagaaattggaaccttccttgatgatgagaatgtgaaatagggcagccactgtagaaaatattttggcagttcctcagtaaggaaaacatagaattaacatagacccagcaattctactcctgggtgtggacccaaaagaattaaaagcaggcactctaacaaaaactaatatacaaatgcatatagaagtactattcataatagcaaacaggtgaaaacaattcaaatgttcatcaagtgatgaacagataaacaaaatgtggtctatccatatatggactattatttattcataaaaaatcaaagtactgatccatgctaaaacatggatgctccttgaaagcattatgctaagtgaaagcagccaggcacaaaaggccacattccacttatatgaaatacccagaatagcaaatccatagagacagaaaacagattagtggttgccagaagctggcagaaggagtgaatgtggagtggcttcttaataagtattgaatctccttttggggttatagaaatgttctggaactagatagtggtgatggctatataacattgtgaatgtactaaatggcactgaacttcacactttaaaattgttaaaatggtaaattttatgtttgcgaattttgcaatagataagtcagaagacatgtacattaccataatgagtaacaaactgacagctgatttctaaataatagcaaatatcagaaaataatgaatgatgtcttcacaatgctaaaataaacaatgtgaacccctctctcaaaaagaaaacctaatgaaaatatcttttatgcgttaaagcaaaagaggaaattaggacacagacaggcacagagggacgaccacatgaagatatagaaagaggacagacacctacaagccaacgagagaggccttacaagaaaccaacccttagccaggtgtggtagtgtgcacttgtagttcttgttacaagggtgcagtgagctagggttgtgccactgcactccagcctgggaaacagaacaagaccctgcctctaaaaaaaaaaataaagagaaggagaagaagaagaaaaggaaaagaaaaaaaaaaagaaccaagcctgctggccaggcgtggtaactcatgcctgtaatcccagcactttggaaggctgaggcaggaagatcatctgaggtcaggagttcaagaccagcctgcccaacatggtgaaacccccctctactaaaaatacaaaaattagctggacatgctggcatgcgcttgtaatcccagctactcgggaggctgaggcacaagaattgcttgagcccaggaggcagaagttgcagtgagcccagatcgcgccatcacattccagcctggactacagagggagactccatctcaaaaaacaaacagacaaaaaaaaaatacacacacacacacacacacacacacacacacacacaaaacaagcctgcctaccccttgatcttggacttgtagcctccagaactgtgagaaaataaatttctattgtttaagccaggtgtgcgtgtgaaaatttagaacatatgacaacagcaaaaaagtcagcatgtggataaatagaataaaggattctaaaatccatgtattatctaggaggtaaagatgttaatattaaaccttcataatttgattaatgttgtagtttataggatagccagtaagtaatagaaatacacacaatgtaagactcccaaaatggtagaagaaaaaatatgaaaggataaaatatactcaacaaacctaaatgaaagcaagcaaagagagataaagaaacataaaacaggtaggaaaaatagcaagataagatggtatatttaaattgaaatataacagtaatcatatgtaatatgaatggaccaaatatttcagttaaaagacaaagattgtcagattgataaaaaagcaaaagtagctgggtgtgatggctcacacctgtagtcccagctacttaggatgctgatgtgggaggatcacttgagcccaggaggttcagcctggacaagatagtgagacttgtctctttaaaaaaaaaaaaaaaaagcaaaagtaaattgtgtgcattttatgagtcatatctaaaacattagatacagaaaagtagcaagacaaaaatgggaaaagaaattatgcaaatatctaaaagatatcgattacagctctattgatagcagaaaaatagactttaaagcaagaaagtattgctgaagattaagaatgtgatttcatggctggacgcggtggctcacacctgtaatcccagcactttgggaggccgaggcaggtggatcatgaggtcaggaaattgagaccatcctggctaacatggtgaaaccccgtctctactaaaaaaaaatacaaaaattagccgggtgtggtggcggacacctgtagtcccagttactcaggagggtgaggcaggagaatggcgtgaactcgggaggctagattttaacacatctctcgtcaattgatggaacaatgtatagaaatagaacaattaacatgattcacaagtttgatcttatagacatatttagaaaatagcaccttgaaattgcaaaattacaagggtggttccaacatggccgaataggaacagctccagtctacagctcccagcatgaatgacacagaagacaggtgatttctgcatttccaactaaggtaccaggttaatctcactgtggcttgtcggacagtgggtgcaggacagtgggtgcagcccaccgagcatgagccgaagcagggtaaggtatcacctcacccgggaagcacaaggggtcagggaattccctttcctagccaagggaagctgtgacagatggcacctggaaaattgggtcactcccatcctaatactgcgcttttccaatggtcttagcaaacggcacaccaggagattatatcctgcacctggctcagagggtcccacacccacggagcctcgctcattgctagcacagcagtctgagatcaaactgcaaggtggctgcaaggcagggagaggggcacccgccattgctgaggcttgagtaggtaaacaaagcggccaggaagctcgaacttggtggagcccaccgcagctcaaggaggcctgcctgcctctgtacgctccacctttgggggcagggcaaagacaaacaaaaagacagcagtaacctctgcagacttaaatgtccctgtctgacagctttgaagagagtagtggttctcccagcacagagtttgtgatctgagaacggacagactgcctcctcaagtgggtccctgacccccgagtagcctaactgggaggcacgccccagtaggggcagactgacacctcacacagctgggtacccctctgagaccaagcttccagaggaacgatcaggcagcaacatttgctgttcagcaatattcgctcttctgcagcctctgctgctgatacccaggcaaacagggtctggagcggacctccagcaaactccaacagacctgcagctgagggtcctgtctgttagaaggaaaactaacaaacagaaaggacatccacaccaaaaccccatctgtacatcaccatcatcaaagaccaaaggtagataaaaccacaaagatggggaaaaaacagagcagaaaagctgaaaattctaaaaatcagagtacctctcctactccaaaggaacgcagctcctcgccagcaacggaacaaagctggacagaaaatgactttgacgagttgagagaagaaggcttcagatgatcaaacttctctgagctaaaggaggaagttcgaacccatcacaaagaagctaaaaaccttgaaaaaaaaggttagatgaatggctaactagaataaccagtatagagaagtccttaaatgacctgatggagctgaaaaccatggcacgagaactatgtgacgaatgcataagctttagtagccgatgcgatcaactggaagaaagggtatcagtgattgaagatcaaatgaatgaaatgaagcgagaagagaagtttagagaaaaaagaataaaaagaaatgaacaaagcctccaagaaatatgggactatgtgaaaagaccaaatctatgtctgattagtgtacctgaaagtgacagggagaatggaaccaagttggaaaacactctgcaggatattatccaggagaacttccccaacctagcaaggcaggccaacattcaaattcaggaaatacagagaacgccacaaagatactccttgagaagagcaactccaagacacataactgtcagattcaccaaagttgaaatgaaggaaaaaatgttaagggcagccagacagaaagttcgggttacccgcaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcttgccctacaagagctcctgaaggaagcactaaacatagaaaggaacaaccggtaccagccactgcaaaaacatcccaaattgtaaagaccatcgatgctaggaagaaactgcatcaactaatgagcaaaataaccagctaacatcataatgacaggatcaaattcacacataacaatattaaccttaaacataaatgggctaactgctccaattaaaagacacagactggcacattggataaagagtcaagacccatcagtgtgctgtattcaggagacccatctcacatgcagagactcacataggctcgaaataaagggatggaggaagatctaccaagcaaatggaaaacaaaaaaagaaaagcaggggttgcaatcctagtctctgataaaacagactttaaaccaacaaagatcaaaagagacaaggccattacataatggtaaagggatcaattcaacaagaagagctaactatccaaaatatatatgcacccaatacaggagcacccagattcataaagcaagtccttagagacctacaaagagacttagactcccacacaataataatgggagactttaacaccccactgtcaacattagacagttcaacgagacagaaagttaacaaggatatccaggaattgaactcagctctgcagcaagcggacctaatagacatctacagaactctccatcccaaatcaacagaatatacattcttctcagcaccacatccaaaactgaccacatagttggaagtaaagcactcctcagcaaatgtaaaagaacagaaattataacaaactgtctctcaggccacagtgcaatcaaactagaactcaggattaagaaactcattcaaaaccgctcaactacatggaaactgaacaacctgctcctgaatgactactgggtacatagcgaaatgaaggcagaaataaagatgttctttgaaaccaatgagaacaaagacacaatataccagaatctctgggacacatttaaagcagtgtgtagaggaaaatttatagcactaagtgcccacaggagaaagcaggaaagatcaaaaattgacaccctaacatcacaatttaaagaactagagaagcaagagcaaacacattcaaaagctggcagaaggcaagaaataactaagatcagagcagaactgaaggagatagagacacaaaaaaccctttaaaaaatcaatgaatccaggaactggttttttgaaaagatcaacaaaattgatagaacactagcaagactaataaagaagaaaagagagaagaatcaaatagacgcaataaaaaatgataaaggggatatcaccaccaatcccacagaaatacaaactaccatcagagaatactataaacacctctatgtaaataaactagaaaatctagaagaaatggataaattcctggacacatacaccctcccaagactaaaccaggaagaagttgaatccctgaatagaccaataacaggctctgaaattgaggcaataattaatagcttaccaaccaaaaaaagtccaggaccagacggattcacactcaaattctaccagaactacaaggaggagctggtaccattccttctgaaactattccaatcaatagaaaaagatggaatcctccctaactcattttatgaggccagcatcatcctgataccaaagcctggcagagaaacaacaaaaaaagagaattttagaccaatatccctgatgaacattgatgcaaaaatcctcaataaaatactggcaaaccaaatccagcagcacatcaaaaagcttatccaccatgatcaagtgggcttcatctctgggatgcaaggctggttcaacatacgaaaatcaataaacgtaatccagcatataaacagaaccaaagacaaaaaccacatgattatctcaatagatgcagaaaaggcctttgacaaaattcaacaacacttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgttcgcagacgacatgattgtatatctagaaaacaccattgtctcagcccaaaatctccttatgctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatatgaaggacctcttcaaggagaactacaaaccactgctcaatgaaataaaaggggatacaaacaaatggaagaacattccatgctcatgggtaggaagaatcaatattgtgaaaatggccatactgcccaaggtattttatagattcaatgccatccccatcatgctaccaatgactttctttacagaattctaaaaaactattttaaagttcatttggaaccaaaaaagagcccgcattgccaagtcaatcctaagccaaaagaacaaagctggaggcatcacgctacctgacttcaaactatactacacggctacagtaaccaaaacagcatggtactggtaccaaaacagagatatagaccaatggaacagaacagagccctcagaagtaataccacacatctacaaccatctgatctttgacaaacctgacaaaaacaagaaatggggaaaggattccctattgaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattgacaaatgggatctaatgaaactaaagagcttccgcacagcaaaagaaactaccatcccagtgaacaggcgagctacaaattgggagaaaatgtttgcaatctattcatctgacaaagggctaatatccagaatctacgaagaactcaaacaaacttacaagaaaaaaagaccccatcaaaaagtgggtgaaggatataaacagacacttctcaaaagaagacatttatgcagccaacagatacatgaaaaaatgctcatcatcactggccatcagagaaatgcaaatcaaaaccacagtgagataccatctcacaccagttagaatggcgatcattaaaaagtcaggaaacaacaggtgctggagaggatgtggagaaataggaacgcttttacactgttggtgggactgtaaactagttcaacaattgtggaagacagtgtggcgattcctcaaggatctagaactagaaataccatttgacccagccatcccattactgggtatgtacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaggatctgttcatgtcctttgtagggacatggatgaagctggaaaccatcattctcaaaaactatcacaaggacaaaaaaccaaacaccgcatgttctcactcgtaggtgggaattgaacaataagaacacttggacacaggtaggggaacatcacacaccggggcctgtcatggggtgggtggacaggggagggatagcattaggagatatacctaatgtaaatgacgagttaatgggtgcagcacaccaacatggcacatgtatacatatgtaacaaacctgcacgttgtgcacatgtaccctagaacttacagtataataaaaaaaaagaaattgcaaaattacacattctttgtaagcacacaaaggaaacatgttagaattttccattttaagctacaaataagctacaaataaagtagtctcaaatttcagataatataaaacatgttttctggtcacaatacaattaaagttgatataaataagaaagataactataaaatcttcctatgttagaatcaagaactatacttttaaacccatgtgtcaaataagaaatcataaattagaaaatattttaaactgaatgataacaaggcatgacatattaaaatgtgggaatcagctaaagcaatatttagaaagaaatgtatagcgttaaaaacatatattggaagagaagaaagcctgacaattaatgagctaaggtatgtctcaagaagctagtgaaacagcaaaataaaccaaaaggaagtagaagcaaggaaataataaagatatgaagtaaatgaagtaaaaaagaaacatacaatagagagaataaagaaaaccaaaagttggttccttgaaaattgacaaacttctggcaagagcaatcaagatgaaaagaaggcacaaataatatcagaaactttaaaaaactggacatcaataaagatcccacaaaaatttctgccaatataaaaatataaaaaatgaggatacttattaatattaaatgttctttcttgttgtatttaccagggattaatccattttacctaattttccaaacttagtgttaaaaggttattaatttaaaaaatccagatccagatggctacactaactatattctaccaatttttcaaaggagaaataatattaaccttgcaaaaattctttcagaaaatggaaaaagatggaatgttattcaattatcttatgataatagcataaccttgacaaccaaaccgaacaagaacaatattagaaaggaagataataggcccgttttattcataaacataaatcccaaacaaaatattagcaatatggatccaaattggatttatgctaggaatgcaagtttggcttatacattagaaaactgatataatttatcacagtgacagactgaaggattatacatattggctgtcctaagcagtgcaataagatgagaaaaagaaggaaaatatgtaaggattgaatatgatgaaacaaactcattgtatgtggaagatatgatggcatagatagaaaatccaaaggaatttatatataaattattagaatttttaaaatttttcaagcttgctgaaaacaaaataaataccaaaattaattgtatttctgtatacctgaaacagttggaaaaatagttttaaatagcatttaaaaattccaagcaggagttgcacattcctgtcagataatggcagctgcctaaatctctccacagtcttcaaaaaccatacatacacatacacacacaattttaaattatgactaaaaccacccataacccatctatagaataaccagaagacaaaaagtactataagtttatatttacaagtagaaaataaatatataaatctagccaaccttgctccagagagaaaccctgtctcaaaaaaaaaaaaaaaaaaaaaaagaagaaagcaaatgttggaaattaactgtcctataaaaacaaaagtgaattactaaatcacaagacccacaaacctctttggtcacatctattaaataaattacacttccatttatcaacagtagagggtactcctggctaagaaacctagtaagccacccagccctcatgtctgcctgcataaatcacctcttattgctgaaacaagaaaatgtaaggaatttctaaatgaacagaaaatagcatatgaagcagatggtattaatgttcttgagtttttattccctctttccttgaaaacctcatcaactttaggcatggccgtacggctcatcttgatcaatagaatgtgattggacatgacatatataccacttccaaatagaagctttaaatgtgattttgtgtttgacacactcttttgtgcctctgctccaggctccagactttaagcctctagaacgataagtgaataaatttcttttgttttaaaggcaccaagtgtgtggtgaatttgttacagtagccctagaaatctaatactaacaaaaagaatgttagagttgaattagaagtgtcagtgagaacttaggaatttaaaaaatcatattcttagcactgttcactgagggaatctagaagtaattacactgcagtaataacgagcccatcccatgcccaaatcttggtctctaactaccattttccagtcaaaagaatctgagctccctagagaaatgactttttcaaggctggatcaaggaaactgccaggcaatcttagatgatcttggtgatcttgatgtgccagaagattaatgggatcatgtgaaaagaacacagaaactggtctgaagggcttcctgttggccagatttgagacaatttgagcatcaaaaggaataatgagggtaatggatcataactggaaaatcagtttgcaaccatcaatgtacttactattgaatacttgtaaagaactttaagggttgctaataccattggataaaagcttgttgtgaaacagaatatttgcatggtctcaaagtctcactccacagattgttaggaaagggaaagggttacctttataaatatagagattaggtggacatcttaaccaagtgatcaaacttagcatcatcaataatgggacaatctggcatcgcatgccccctgatttaatgcagtaaggattaagtctaacaaaagatgtacaaagcctccaaatacagcgtaaacatttgtaaaataatctcagaacagggaccttaatgtttctcaaaaatttttccaaatacagaactttatttctatagatgtttatggtatatttgccatgctatatacattatgctatatattctatgtgctgaagatacaacaatgaccaaggtctttgcccttgtggaactgacatttggtggcggagacagaggaaacagtcaataagcatgtaaagagataaaggaaaagatactgaatgctacaaaggaaacaaataagttgagatttagaacaaaaaagagtcctattttacaagaggaataatgaggaagacctttctaaagaggtagctcagcactttgggaggccgaggcgggtggatcacgaggtcaggagatcaagaccatcctggctaacacagtgaaaccccatctctactaaaaatacaaaaaatgagccgggcatggtggcgggcacctgtagtcccagctacttgggaggctgaggcaggagaatggcgtgaacccgggaggcggagcttgcagtgagccgagatggtgccactgcactccagcctgggcgacagagcgagactccgtctcaaaaaaaaaaaaaaaaattgaggcagaatttcgctatgttgcctaggcttgtctcaaactcctgggctcaagcaatcctcctgcctcagcctgctgagtagctgggactccaggggcatgccactatgcttagtttaagaggtggtatttaaactgagacccgaagggtaaaaaacatggataaaagaagaaacagaaggggtaagagccttccaagcagagggaatcacatatacaaaggctctcatgttaaataaaacaagagttgacattgttgagaaactgaaagatcagctcatctgcgatgcggtaaaataggaggaatgcagtgggagaacagatcagagacttgggcaggggctatattaggcagaacttggagaccagagtaagggggccaaggtgggaacagaccgattaaattggcatctcttgggggggtgggggggtggggaacttacccatgcatcattttttaaaagctccaaaggcgattccaataagcagccagggttgggaacctagggggaaaatgtagctagatgaatgaagatggcccaaacgtcttttgttctgatagctaaactctctgtaggatcacagtgttacttcacagtgcatttgccaggaaaagtctcttcccatttggaatccgaagtaaaactgacaccacacttgaagatgccaggattgttagaggaaaatgtcacccaatagctccaggaagcaggagccctactgttgctgtttaaccacttctttcccattttggtggcaagttgcctccttttacacaaactgcctcaggagatcctaaagatatcatggtgtctgtctgtccttgcaagagcatgcattatggtaggacattgccttcattctgttcctttttctccaagactcttgcttattctcaccatttggctggactttctactgtaggattacctcggaatccacacaaaacccacagggtttcagagttgccttgaattacacgttttgaacattcagatcttcattttcccaaacatccacccagttataggtgacctttgctccaaagtcctggagtagcaaggtgccttgagtcttagactcttcccacttctttctctcttctgcatcccctcctgccaaggttgcccagccacactaaattgcatgccttgctgtgttgcattcgttatcattctaaagttgtcaccaacatgtgcgaaaccagtttatctaataacgatagctaccattttctgagctcttgccatgtactcctcttgccacagcaaatgcattgacaagggagtctgctggccaaagcctgactctcatctccagatggtccaacacagatgctgtgtgtgacccaggacaaagcacttaatgtcactgaggtttgggaagtgggtgagaacactgtagatataaggcctagctagagtgaaggcctccaaagcagggtgctcttaattctagatgtcccagatgcgtaggacagagtcatctagtcatcttccagggtttaatcctggactactggaaacaactagaagtgagaaaagcgtctgtgctttgcagtgaccattgtcctgtcagacaaccaataaatgctatctttcctctttcaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggagacaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttgataatcttattttggcattcttttcccattgactatatacatctctatttctcaaatgttcatggaactagctcttttattttcctgctggtttcttcagtaatgagttaaataaaacattgacacatacaaacaaatgcctttgagaattgtgtttttacactggaaataaaaatgtgaacactgatttttaaaacaaataggggcactgaatagcaagatggacactctagaaaaccaaattagtgagttagaaaaccagattaaattgaactcagagtaaaaatgatataattcatgagagtctgaataaaataaatcagaaatggagcctcaatccaggagaacagcttatatggagagagagagactgagagagaaatgggagtttctgttcaatgggcataaagtttcagctatgctgctgggcacagtggctcatgcctgtaatcctggcactttgggaggccaaggcgggcggatcacctgaggtcgggagttcaagaccagcctagccaacatggcgaaatcccgtcgctaataaaaatataaaaattagttgggcatggtggcacatgcctgtagtcccagctacttgggaggttgaggcacaagaatcgcttgaacccgggaggcgggtggaggttgcagtgagccaagatcgtgccgttgcattccatcagcctgggcaacagagtgagactccatctcaaaaaaaaaaaagtttcagttatgcaagatgaattaagttctacagatctaatgtacaacattgtgcatatagctaacgataccatactgggcacttaaaaatttgttaagagagcagataccacgttgtgttcttactacagttttacaacaatgcaaaaatgcattgtaaacactatgtgcaaatagaatagcaaagaatgtatacagtgcccatgagcataacattctagtggacccacaatgcatcagagttcagtgagactcaaagggagaagaatgttggcaaagtcagtggggaggagaaaatgagtgtgatgaaataggcggtctcattaaacttcccttacaaaacacaagatcaaagataaaattattaagaatttcgagacagtgacatcagagcaaacgaaacatagg

SEQ ID NO: 2 - DNA, 188930 bp, Artificial Sequence
  synthetic construct
tcaccatggctacattctgatgtaaagagatatatcctatacctgggccaaatgtaaacagcctggaaaagtgttaggttaaaaacaaaacaaaataaataaatgaataaatgccaggtggttatgagtgctattgagaaaaatgaagccaagagggatatcagtgatgcaggtgggggtaaagagcttacaacataaatgtggtgttccatatttaaacctcattcaacagggaagattggagctgaaatgtgaaggagttgtgggagtggaactacgtggaaatctgggggaaaggtgttttgggtaaaagaaatagcaagtgttgaggtccaggggcatgagtgtgcttgatattttagggaagagtaaggagaccagtataaccagagtgagatgagactacagaggtcaggagaaagggcatgcagaccatgtgggatgctctaggacctaggccatggtaaagatgtagggttttaccctgatggaggtcagaagccattggaggattctgagaagaggagtgacaggactcgctttatagttttaaattataactataaattatagtttttaaaacaatagttgcctaacctcatgttatatgtaaaactacagttttaaaaactataaattcctcatactggcagcagtgtgaggggcaagggcaaaagcagagagactaacaggttgctggttactcttgctagtgcaagtgaattctagaatcttcgacaacatccagaacttctcttgctgctgccactcaggaagagggttggagtaggctaggaataggagcacaaattaaagctcctgttcactttgacttctccatccctctcctcctttccttaaaggttctgattaaagcagacttatgcccctactgctctcagaagtgaatgggttaagtttagcagcctcccttttgctacttcagttcttcctgtggctgcttcccactgataaaaaggaagcaatcctatcggttactgcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaaggtaaaggcatgtcctgtagggtctgatcggggccaggattgtggggatgtaagtctgcttggaggaaggtgcagacatcgggttaggatggttgtgatgctacctgggccccaaagaaacatttctgggtaaggtgtgcacacatctgtgttattagcagaaatgctaactgccaattcttttcataggtctgacctatttgttgatattttgttctgttttgtccattgcttctcttcgtcatatgctgctcctccagaatctagagactggagtagagggagggtgaagggacaaagacaaaacttccctctgcctgcccaagcttccatagagagaatcaaggcaatgaaatccaatcaatatcacacacaagtttcatgtctggttctcttgtgtgtacatgcaatgtgtgtttttataatatcttttcctactttgggtgtaaggataatatgagccttgagttcagaagcttttcgtgttttgggggttctggtgcatttaggcagagtattaaataactttatcaatattgtctatggtcatcagttgattcagatttttctacctcttcttcagtaaatattggtatattttggtctatactttcatagaaagcaatctactgtccctagatttgataatgtattggtatcaagttatgtaagagtctcctgtgattttgttaaactgttctgtgtctgtagttatattttctttttcattccttatgttgtatatgttctcttcctctcttttaaaaataatatttccaggagttttcttgattttattggtcttgtcaagaattttcttttggtttgatttatcaatctcttttttctttctgttgcatcagtttctgcttctactttcattgatttattccttccttctaatttcctttggttcattttgttgttagatttttgcttcttgagttgaatgctgaaatcatttattttatttttttgtcttctttaaatgtgtattataaagatttaaatataatacatagattgtggctgtgtaaacattaaatgtggtcatgttgtacatactttatattctttttggttctttctgtttggctccccaccctctttccacatcagtccccttctcccccacctcagctaggtaaccccagtatgataatatatattcacatacacatacacacacacaaaggttttcttggacattatttgttttataaaattgggacattatacacacatttctcactcattaacacgtactagaactctaagtcaattggtatagctttaattcattatttttattggctatataagattctatggtatggctgtatcacaatttagtcaatatgttcactttattccagtttttggctactatatcctatatcattacatactggtgcttttacttctgttgaacaaacttgcaagaggaatattaatggaacgaagggaatgtttccttctaagttttaatttccaaagaggtcagaacttttcaaacatttctaccatcgaagtatgaaaatggccttctctctgcattcacatagcgataagttttatcctgtttttaaaatttgccaattttacaggtgtagagtgatattgcatcattactttcattgtgttatttttatttctaataagttgagcatctttttaaatgcttgttggctattggatttatttgggggatttaattagtcatatgatttgcccattattctttggactctttcatttaaaaaaattatgagaacccttttattattacaaatattaactctttgtcatgtatattgcagttttccccaagatctattgtttgtctgttgactttcttataacttttaccaaaacagtttttaatttttataatcagagatatcttttctttcatatcttcagagtcggcaaggttggttaaaaatgtttcccacacctcaagattgtacgtgtaatctcccagattttcttgcaagatgtttactgtttcgctttttatatgcattgcttcaattatctgctaattacttttgtcatatggcatgagagagggatttgtctagttttatttccatccagatcaatagcctattgtgatggcaccttttgccactgatttgaatcaacacattcatcatataaagttctcatatatattagcatatatttctggattcattaggctgtttcactaatctactattatcttgctatgccagtaccatagtgatttgattacagtgagcctatgatatcttctgatatctggtgggtgaaagcaatcctcactattctttttgtacctttcttagctattcttagacactttattcttccacataaaactgttaagatatttttcaaattaaaaagatccaagccctgttgtgattctaactgcaatttcattaaactcagaccttaattttattaatgtaataaatttaaatatttttcttattacatttatctctgtgtattttataagtgtgatgctattgttaataagatagttttctcctatttccatttatgagtgcttagtaccaaatagagataagctattggtttgtgtattttcagctttttcttttgagcctgggtctcattttgtcacccaggctggagtgcagtggggtgatctcaccttactgcagcctcaacctcctggattcaagcaattctcctgtatatcagccccccaagtagctgggactacaggagcaggccaccatgcccggaaaatttttgtatattttttagagatgggtttttgccatgttacccaggctggttttcaactcctgagctcaagcattccccccacctcagcctcccaaagagctaggattacaggtttgagccaccgcacccagccattgtatattcatcttaaatctagctaccttaccaaatttgcctattaattctagtaattttaccctaaagtctctgtgagtattgaatcatatcataagttaaatgagacagattttagctcatttccaatatttatagccagttatttcattttcttatcttattgaatttattagaaaacaagagcaaatgttaaataataacaatgaaagtgaacattccttctactctatgattttacttgaaataatttttgtattttgctatttagagtaacatttgctgttttggtttttgtaaatggtgtttattctattctcatttgccacaaaatgtttatcataaataagttttcagcagctggtatcatctgaattgtcttctttgatatgctgatgaacaaattatgttcatagatgtcctgacactaaatacccttacattcttggagtaaaatctactattcatggaatttgatcattagtgggttctatgtactatttctttagactattcttagtagattttcactactcaacctactaataataataaacaaagttttgttggctttatcaaatgaattgatgagtactccatctttttctattgcttagaatagcttaagtaacatttgaattatccattgtctaaaagttaggtgagactcacttatgaatccatttggtcctagtggcatttgcaatatctttaatcacccctccaggctcttctatgataatcagtcaattcaagtttcaacttccaataattatatacctttctaggaagtaactttatttattttttcaattttgttgccacagtgttgcatgtagcactcactcatgattcttttactccacattatctgtagttatgtgccctttcttattcctaaattcctctatctttgctatttatctttttttccttgaataagcttgccaatgacttgtctattttgttgctggtggtgctcttttcaaagaatgggcttttggattttttttttttctagttggtataaagcatttttattttcactgagcagaaaaagaagctattgattcattaactgtgctgctttattggcatgtagctatgcactgttcacacattaatatataaaactcgtcagtctgttttattttgtctgatgggaaaacatgaacagtgagatttcttatgcaaaaagtgaacagttcaactatgctagctccatatacctttattaacattccagagacttatcctctcaacatgatctgatttctgtaggataacttttcaggaaaagtattttctgatcagtgaagcttggagatataaataagcaatcggccaggtatggtggttcatgcctgtaatcccagcactttgggaggccgaggcaggcagatcacctgaggtcaggagtttgacaccagcctagccaacatggcaaaactccgtgtctaccaaaaaaaaaaaaaaaattagctgggcatggtggtgctcacctgtaatcccagctactgaggaggctgaggcaggagaattgcttgaacctaggaggcggaggtggcagtgagctaagattgtgctcagcctaggtgacagagtgagactccatttcaaaaaataaaaaaataaaaaaaagcagtatctctcatattcattaactggaccctgactttcttaaagctcaccccaaagctgaagtccatgaaggcactagttctcaaacttcagtgtgcataagaatcactcgggaagcttattaaaatttacattcctaggccccatcctcagcaaactatttagtccccaggtaattctatcccaccccaccccagctttattgtggtataattgacaaataaaagttgtatatatttaaggtgtacaagataatgttttgatgtaagtatacattgtaaaatggtatagcatgaagggttttcttttcatttttttcagaatagtttgtaatatcttctttgatttcatctttgataatctagacgtatgattttaattgctttttaaatttgtttatcaagttagtttgtagtatttgggtcaacattgaatatcctgttaatttcctattgctgtgtaacaaactacatcaaatgtatcagcttatgacagacccatttactgtctcacagtttctgtgagttagaagtccaggtggactcagctggatactctgtgcagggtcatacaaggccaacaccaaggttttaatagggctgcactccttagtgaaagctcttggggagaatctgcttacaggctcatttggaatgttagcaaattcagttccttctctcactttccatgtagtgccctctaccagcaatggtgcatcaacactctctcatgcttggaattgctctgacttcaattttccgtgcatatctctggccttttttgcctctctcttttacttttaaggactcatgtgattacattgggccgacctgggtaattcagaatactctccccatctcaaggtcagctaatcagccccttaattccatctgcaaagtttaatttgccacataatatatttttggacatgacaccaaggagcaaaggtgatgtgggccaaatttttacctgccacaggtatagtttacatacaatgaagctcatcaattttaaatatgcagtttgatgagttttgacaaatgcatacacttgcataaccaccaccctaatcaacatgcatttacatcaaccctcctgcaactttttaatgagtctctcccactgacctggcctcagccaataaactgctatctggaagttacagatttgttttcacatgttctagaattttacatcagtggaatcatacggtatgtattcttctatggctttttttcttcagcatcatgatttggaaattcatgcaggttgttgtataaagtatttctatcctttttattgctgattactgctccattatgggattatatcataattttggattatttccagttaggagcaaatacaaataaacctgctatgaacagtgctccacatgttttgtgtgaacatctattttcatttatcttagttaaatatctaggagtggaattgctggatcatatggtaagtgcatgtttaagagaaactgccagacagatttcttgaacgtaccattctatactcccaccagcaatgcatgagagttccagttgcaatatatcctggacaacatttgatgttgccagtacttaatgactgcacagtggtatctcactatacttttttttttttttgagatggaatctcatcccatcacacaggctggagtgcagtggcgcaatctcagctcaacatctgcctcctaggctcaagcaattctcatgcctcagcctcctgagtagctaggactatggtcacacgccaccgtgcccagctaatttttgtatttttggtagagacggggttttgccatgttggccaggctggtctcaaactcctggcctcaagtgatccacccgcctcggcctcccaaaatgttgggattacggcttgagccactgcacctggttatacttttaatttgcgtgtctctgatgactaaagatgttgagcatctttgcatgtgctaattagccattcctatatcttcttggaagtgtctattcaaatcattggtcctttgtttttaaacgtagtttcaacttttattttagactgaggaggtacatgtgcaggtttgttacatgagtatgttgcatggtgctgaagtttgggttacgaatgaatgatcctgtcactgaagtagtgaacatagtacccaataggtggtttttcactccttgctacccttcctcctccctctttcctctagtcgtctccagtgtctattattctatgtccatgtgttctcatcatttagctcccacttctaagtgagaacatatggtatttggttttcagttcctgtgttaattcacttaggataatggtttgccagtttttaattgggttgtttgtcttgttattgttgagttttgataattttttatatattctgggtacaagactattcagaggtacctgttttgaatgtttttttccaatctatggcttgcattttcattttccaaatggtgtctttcaaatagtggaaatttatagttgtagttaagtccaatttagcttttcttcttctatgattcatgcttttttttcccctgtcctaggaaatctttgcccacctcaagttcacaaagcctttcttctgttttcttctagaacttttatcattttagcattagtatttaggtttataatacattttgagttaaattttctgtatggtgtgacttttctttctctattgaattcccttggtgcctttgtagaaaattaaatgactgtatataggcaaatctgtttatggattctctagttccatagatgtgtatatctgtgcttatgccagtaccagattgttttgattgttgtaactttatagtaagtcttaatatcaggcagtctaaaacctccaacttacttttttattgaaattgcttttgatatatttaggcttttatatttctgtattaattttatagtcaactagccaactccaccaaatagccaactgggattttgactggaattgaattgaatctgtagatcaatttggggagaattgacatttaaacaatactgaatctttcaatacaacaacatggtatggctttgtttctttaaattttctttaatttccctctaggatattttgtagcctacagagtagttcttgcaagaattatattaattgtatccccaagtattttgagggattcgatgctattgttaattgtatcatttttatttgttttcgttttccaatcatttgttactaaaatatagaaattcaattgatttttgtatattgaccttgttcactctaatcttgttaatttgcattttagctctagtagcgttttgcacttcttttagaatttctacatatacaataatgttgtctgcaaataaagacagtttgcttcttcctttccaaactggatgctttttattttttttttcatgccttactgtactggcaagggcctccagtacaatgttagatagaactgatgatagcagaatccttgtcttcttcctgatttcagagggaaaatattcattattttaccattaagtacaattacttgtaaattttttcatagatgccctttgtcaaattgaggaagtttccttctattcttggtgtgagagtttttatcaagatttgatattagattttgtcaaatgctttttctgcatctattcaaatggtcatatggtttatcttgtttattctgttatggtgaattaccttgattgattttttaatgaggaactagctatgtattcccagggaaaaaatccacctggttgtgacatattacattggtaatattttcgctatggactgaattgtctccacctccccccaccccaaattcatatgttgaagtcctaactctcaagatgattatatttggagatagggcttttaggaggtaaacaaggttaaatgaggccataaggatggagtcctaatctgataggactggtggcctcataagaagagagaaggttctctctctacactcatgcactgaggaaaagccatgtgaacatacagcgagaaggcagccatctaccagctgggaagagggctccactagaaactgaccgtgctggcaccctgatattggatttccagcctccggaactgtgagaaaataagtttctgttgtttaagtcacccaatctctagtattttgttatggcagccctggccaactaaaactgttttgttaagggttttggtggtgatggtggttttttagtttttgcgtctgtgttcatgatggatatttggctgtgattttcttataatgtcattgtctggttttgatataagagtggtattagtccgttctaatgctgctatgaggacatacccgagactgggtaatttataaaggaaagagatttaatggactcacagttccacatggctggggaggcctcacaatcatggtggaaggcaaaggaggagcaaagacacatcttatatggcatggtggcagacaagagagcattgtacaggagaactgccctttataaaaccatcagccctcatgagacttattcactataatgtgaacagcatgggaaaaccccactgccatgattcaattacctcccacctggtccctctcacagcacatggggattgtgggagctacaattcaagatgagatttaggtggggacacagccaaaccatatcaaagagtaagactattctttttttttttttttttttttttgagacggagtctcgctctgtcacccaggctggagtgcagtggtgcgatctcggctcactgcaagctccgcctcccgggttcacgccattctcctgcctcagcctcccgagtagctgggacgacaggcgcccgccaccacgcctggctaattttttatactgatagtagagacggggtttcaccgtgttagccaggatagtctcgatctcctgacctcatgatccgcccacctcggcctcccaaagtgctgggattacaagcgtgagccaccgcgcccggctgactattcttataaaatgagttgagacgtgttcactcttctatttaatgaaagagtttgtgtagaattggtatcatttcttttttaaatgtttattcaccagggaaatcatcttatcccagtgttttttgttttggtttggttttttttttaagggtcttaattgtgaattctatttttaataggtaaagggctatttgaattttctatttcttataggataaattttaataatttcttttaagaaattccatttgagactgggcatggtggctcacacctgtaaccccaacactttgggaggaggcagcaggattgctctaggccaggagtttgagatcagcctgggcaacataacaagacttgacttctacagaattttttttcattagccaagtgtggtaacatatgcctgtagtcccagctacttggaaggctgaggcaggaggatcacttgagcccaagagttcaaggctgcaattaactatggatcatgctactgcactccagcctgagcaacaaagcaaggctctgtctcaaaaaaagaaaagaaattccatctgagctgttgaatttaatagtataaagttcagaatatttccttaccattttttcactccttggaggtatgatttacatactgtaaaaatcacttattttcagtgtggagattcttttcctttcctaaatctccacatttttattgacatatactttacatatcataaaattcaccatttgaaagtgtacaattcagtggtttttagtgaatccgtaaagtgtacaactatcatctttatttaattccagaatattttcatcacctcaaaaagaaaccctgtaatcattaaacagtcacttctaattttcttcctttccccagcccctggcaaccattaacctactttccgtcactgtggttttgcctattctggatatttcatgtaaatgaagggataaaatatgtggccttttgtgtctagcatcttttgcttagcatgttttcaagattcttccatttttgcagaatgatagaggagttaaaataagaaaataaagatatagtaagaatgaaactattttcattttttaatttaaaaaaatcttccatgttgtagtatgtatcagaatttaactcctttttatggctgaataatactccattgtatggatagaccacattttgtttatccattcatctgttgatggacttttggattgtttccccttttggctattatgaataatgctgctatagaacattcatgtacaagtctttgtgtacatatgcttttatttctcttcggaatatacttaggaatataattgctaggtcacatggtaattctatgtttaacttttagaggaactgccagactttttcaaagcagctgcaccattttacattttcactaccaaagtatgagtgttccaatttttccatattcttatcaacacttgttactgtctgtctttttaattatactcatcctagtgtggataaagtgatatctcattgtagtttggatttgcatttccctgatgacttacgttgttgagagtcttttcatgtgtttattgaccatttgtgtatctcctttggagaaatgtctatttaaatgctttgcgtgtttttaattggattatttgttttttagtactgagttgtataagttctttatttattcttaatattatacccttatcagagctatgacatgaaaatattttttcccattctgtgggtagtattttcactttcctaatagtatcctgtgatgcacaaagtttttcattttgatgaaatccaatatttatttattttacccctttggttgcttgtatttttgttgtcatatctaagaaatcaatgtcaaatcaaagatcactaagatttaaacctatattttcttttgagacttttatagttttagttcttacattgaggtcattgatccacttggagttaattttggtatatggtgtgaggaggggatccaagttcgttctacagcctatatagcctgcagatgagcaatgttagtgaccttgaaagtagaggcccaggttgtcagtagcctggcatctaactaaacaaccatttatccattaaagttagccctgttaacaattaatattgagataattttacttaatacactgtgtatattagtgtccatctagcatgcagcctgaggcacagagaataatagtttgagtataaaattgaattgaatggaatacatcattaatttattatctagctttctgttattgtataggcagtcacatgtatttaccagaaaaaagttgatagaatttttattttaatgaaacccttttatactttagattattttgatgctgattaacaggataagctgactctggacacatcctgacagcctctgccaaggtttgaaataaacagctgggaaaattcagttttatattatctgttcccgcagctgctcagtttcttctaaccacaggtcagggaatataataggttttccgattagttttagataaaatgtgaaagaacagttcatgtcaaggacaatggttgccaaatatatttggcaggatttctatattgaatcccaaaggaaatacacaaacaaaaccccacaaaagttaggaaggagtaaaacccaggaaccctggaacattttgtcatttactatgcagatttgcctgaaagtgagacaggcaaataaatcacatgtttctgccagcgtggaaaatattcactcaaatggcaaaggtctcaggctggggagctggatattgtcctgtaataggttcatctcagaactgaatcacacacttggagggtgttaatgctcttaggaacatctagttattccctttgaatagagtcctgtcctgaatcacatatacttgacctagggcctaggcctttttgtttttctgtctcacaatcttgtttctccatcaattatgtgttttcactcttccctcagagagggaaaaagtgtttctgtgtgctcttgatcctgttccctctctgatcttccaatctattgctctataacatattttatatgtgtcttatatcttcattttagtcagaaacatttatttatttatttatttatttattttttgagacagagtctaactctatcccccaggctggagtgcagtggcatgatctcggctcactgcaacctctgcctcccgtgttcaagcgattctcctgcctcagcctcctgagtagctggcattacaggcatgccccaccacgcccagctaatttttgtatttttagtagacagggtttcttcatgttggcccggctggtgtcgaactcctgacctcaggtgatcctcccgcctcggcctcccaaagtgctgggattacagatgtgagccattgggtctggcctttaatcagaaacatttaaagtgaaagcactgtggtaacttatgttgaaataccttagaaatcaatggaaactgcacagagagggggtaggatagacgtagtggaaccaaggatatgatatggaaaaaggagaaaggtagcaaactagggatgagttggtgaatgtggaagggcataataatgttaaatgactgaaaactacataggcttatgttaagactagtgccatggaaatttttagaggtagatgacattagagtatgtttaaatataaattaatgttcttgcagtgagccgagattgcgccactgcagtccgcagtccggcctgggcgacagagcgagactccgtctcaaaaaaaaaaaaaaaaaaattaatgttactggttgtgttccctagatgtagactctgagatgaagattaacatgcaggaattttatttggagtgttcttgggatcaacacctgaggaatcagggataggcagagggagaagcgcgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccaatggctgggactggggagttctttcctagactgccatccgggcgcccctcaccctcttgctgctcagctccaggtcgtcgtgggttcagggctcagctgcacgctcctgcccgcgccctgggcgtgatggcacccccagcccctgccattcttccccctcaccccctctccctgccactgctctgcattgccctgggttagcctggcggggccaggtggcacccgccgtatactcttgcctttctgctgcaggggcctttctgctgcgggtcccagagctgcagggaggggcggcagagactccccacgtggctcattggcgggggtgctaatcagagttcttttgctgccactctttgattcccaaaccccatgtaatcttcttagtggggacacagaatcatctttgaattcatacatatacagcaccttggaggctggccctccatcctcacagagacctgcctccaagctggagttctacctgtgcctggttgtggacccactccctcatctcttttgctgtacaatgattccccaggtctacacggtgctatatggaattccacatcagtgaatcaaatcctctgtaagatttcagatagtggtgctggctaaggccctgaagggaggaaaggctaagttacgccaagattaggtatcacaatgaagtcctgtcctttctaggatggaaggagttcagtgtgtctggccaccgagaagctggtttgtctctgtgatggacaataccatattgcagcaatccccaacctttttggcaccagggactggtttcgtggaagataatttttccagagactttggggttgttgggaatggttacggcatgaaactgtccgcctcagatcatgcggcattagttaggttctcataaggagcacaaaacctagatcccttgcatatgcagttcacagtagcattcgcactcctatgagaatctaatgcagcagctgatctcacaggaggcagagcccaggcggtaatgcaagtgatggggagccgctgtaaatacagatgaagctttgctccctgcctgctgctcacttcctgctatgtgaccccattcctaacaggccacagaccagtactggtcaggggcccaggggttgggcccaatatggcatattgggagctcagcattgatttttgttgctggcaggttggactttggtggcaacagtagctagatcagccttagtcagtgggaagccacgcttttgggtccatgcattaattctctccctgctgctgtagccacttagctcatgtcttgccagtactgcgatggcctatgcagaggctagctgatgtgaattgccagagtcatttttatatgtgttgttggtttgtgcttccttcaagatggatgctttctgttggcattaacgtattacttggagatttttctagtttgtgtccactcactaatatgcctttgtcccaacttttttctggaagagcttccttatcagtacgctgggccctggccctcagccagtacagaaagtcatttgtcaaggccttcagttggcagacgtgctccctggactacgtgctttctcgggtgtcccagaaaccctggaatggagtgaaatgcagggctacgtgggagagcagggaggcaagaattaagtcggccccacctttgcccaactcagtgggtctccttgagagaggtctgcagtttcaaggagacttttcagccaatctgctgcgagatcctgtgaaggggtgtgaaggtcttcctctgtgactatagattggccagtctctccttgtgtgtccaacagttttcattatactttatgtgaattaatgcaaaactgctaggtttaaactgctcaccattttagggatcccttctggattttaccttccttaaggggaaattttcctcctttcctcagttcatcctttctgccttggctttgacgtggtctggaggccacagagcctcctcctgagaacctctctctggtgtgtctgtttgtgtccgtccctctcctttcgatcattccctgtggttcctgttgggcgcggctcccataaacgcacagagcagggtctgctttgtctgcaacctgatgcattgttatttctcaccaaaacttgcagtccaaacatcacatttccgggccacactctttgtcagagctccaggggcacaaccccggggacctgctggaaggtgccaccgtgacgtgtgcctagatgcgttttccctcagttaccacagcgttcctctggttctggtggctggagggtgaccgcgtgcttcatgaagggggtccttactgcttcgcatccacccttttcacggaaagcactttgtcacatgttttcagtgtttctaagcgattttctgccaatcttgtgtgctaagattgtgtggcagcgtttccacagatttatagctggcaatgaattctcccaaaggaaatcagacaaaataaaatgtttccaacattgttcacatactgacaacttatgtgcttccttgggtgattttacaactttttaagcacatgaataaaaattattgtctgcttttttctccttttttctctcttttttttcttgcatgcagaaagtttataggagggggatcctctggatcaacacccatgggggagtgaaggaagcaggattgggtaaaagaagttgaggtgatacagtctgaataaaggtcagtcccacagggagctcaagctaggatggctctgcagagatgttctctattgaggcaagttgtctggacctatatagtcccacctttaccaggaataaggcatgagtttggatgtggtgactgacttcagccaaaattggttctcagagaggaattcagattagagttgtcagctgtcagcacacccagcagcttaggaaataagtgctttagtcctgaagcggtgaatctggacaccagcctccactgtggtccaccctttctgctgctcagattcatttgcttcataagttctggaatggttccttcaggattctgatgggctccctttcctggggaaacaaaagagaaaggtttggaacacagcacaactcctgctgctttagcttttcttgagtctgcaactggtactcatcatcttccccttctactacccattctagatccctccccccaccaccctctcaattcatacttctgctgctccaagtgggttaccagataaggtatctggtcatcatgccctttgtaagccatgactgtacttgtccatttatcatcaacattgaacaagggaatactaagagatacccaggcagatgacctggctgccaaatatattctcctctgtctccattgtgtaatgtcagcccttcctcctgatgatcaggatcggttacgcttgccaggatagtgactcttttccttacctcttggtctcttaatagtgatctgaagtaatatgatggcaaccatagtttcaagtttaatgagactcttggtgtgtccactggcggacatattccccttttaagaaccagtacttctaaactctcagagcccagagttgggataagaggcatagtttccctaattgggtcactgggagtaatggtagtgtgaggctgctcctacttacactccttgttttccaaaaccatatattttacttcgggacacaccccactaaacgatggccattgatctagagtatatactgcatcctgcaggatggtgcctcgtccttaggtattatgtctaagctagtgcctcagctgtgccttcaacaagctgtcctaccactctatcaagtgggtagcttctgggtagtggattccatggtcatgtatcttcttgctttaaagtaggtctcttggtctgatgcagtgttatgtaagatcaaatattctgtgaggccttgaatggtggtgtttactgaggctcaccaagcaactgaatgattttcttgagaaatggtgacatatcagagccttagctttggtctctgttactggcaagttgaacattaacaacatcagtagctagatctgtattgatgagtccatgatgttgggcccatgcatagcctctgccatggctcctcctttcatacatccattttgtaagaattggggcaccaacagcagagactggtaagcatcaaagtggctaagtcattcagtctacttggttgtttagtgctgtttctgtggctgatgttcttttcatttattcattctgtaatgcgtatcctttgtagattcaatttccttctctctgaacaacttctttggatatttattgaaaggcaggtctactgtcaataaattccttaatttttattgtctgagaaagtttttatttctccttcatttttgaaggatactttcacagagttcagaattttaggttgactgttttttctttctctcaacactttaaatatgtcagtgcactctcttcttgtttgcatggtttctgaggcgaagttggatgtaatttttatctttgctcctctatggataaagtgtttttccccatctggtttcttacaacattttttgtctttgattttctggagtttgaatataatatgcctaggtgtagggtttttttatttgtttgctcgtttgcatctatctttttttttttttttttttttttgagacagaatctcgccctgtcacccaggctggagtgcagtggcgcgaactcggctcactgcaagctccacctcttgggttcacgccattctcctgcctcagcctcctgaatagctgggactacaggcacccgccaccacagctggctaattttttttgtattttttagtaaagatggggtttcaccatgttagccaggatggtctcgatctcctgacctcgtgatctgcccgcctcggcctcccaaagtgctgggattacaggcgtgagccaccgcgcccagctgcatccatcttctttggtattctctgagcttcctgaatctgtggtatggtgtctggtgtctgacattaatttgggggaaattctcagtcattattgctttaaaaatttgctcctattcatttctgcattcttcttctggcatttccattatgtgtatgttacaacttttgtagttgttgttccacagtttttggacattctgggcccatgcatagcctctgccgttgttgttggtgtttttttttttttcagtctttttttctctttgcttttcagttttgattggaagtttctattgtcatgtcctcaagctcagagattctttcctcagccatgtctcatcaaccaatgagcccatcaaagacattcttcatctctgttacagtgttttgatctctagcatttcttttttattctgtcttagaatttccatatttttccttatgatatacatctgtcattgcatgttgtctactttttacattaaagccattagcatattaatcatagtttaaaaaattcctggtctgataattatgacattcctgccatatttgactctgattctgatgcttgcttgttcagtctcttcaaattttgtgggttttgccctttagtgtgccttgtaatttcttgttaaaaggtggacatgatgtactggctatgaggaactacagtaaataggcccatagtgatgtggtgagatggaaagaaagaaaagatgctcaacatcactaatcattagagaaatataaatcaaaactacaaagagatactgcctcacacccattaggatggctactatcaaaactaaaacagaaaataatgaatgttggtgaggatgtggagaaattggaacccttgtgcactattgcaaatgtacaatagggcagtttctctaaaaattaaacagaattaccatatgatccagcaactcgacttctggctatatatgcaaaagaactgaaatggggtcttaaagagatatttatacatcaattgtattagggttctccaatgaaacagatccgtgtgtgtgtgtgtgtgtgtgtgtgtgtgtgtgtaaatatatgccaatggtaaaagtacagggtctgagtcagaaggcagaaccaagaatgcttatgtccaagggcaggagaagacagatgtcccagttcaaacagggagagtgaatttgcccttcctctgtctttttgttctattcaggccctcagtggaatggataatgcccacccacattggtgagagtgatcttctttaccaattcacatgctattctcttctggaaacatcatcacagacatacctagaaatactgttttgccatgtatctgggcatctcttagcccagtcaagttgacatataaaattaaccatcatatccatgtttataagcagcattattcacaatagctaaaatgtggaagtactgcaagtgtctattgacagatgaatggataatctaaatgtggtatatacacacaaagcattacgaaagaaggaaattctgacacatgctacgacatagatgaaccttgagtatattacgctaagtgaaataagccagtcatgaaaagacaaatgctgtatgattccacttatattgggtacttagagtagtcaaaatgatacagaaagtagaatggtggatgccagagactggaggaggtgagagttattgtttaatgtttatacagtttcagtttacaacataaaattaattctggaggtagatgggagcatattacacgttttctttttggagatgggatctcactctgttgcccaggctggagtgcagttttgtgatcatagctcactgcagccttaactgtctgggctcaagtgatcctcccaccccaggcaccaaagcagctaagaccacaggtgcacaccaccacgcctggctaattattattatttgtagaggccaggtactgctgtgttgcccaggctggtgttgaacccctgggctcaagtgatcatcctgccctggcctcccaaagtactgggattacaggtgtgtgccaccacacctggccagaatatttaatgctactgaactgtatatttaaacatgcttgggctgggcatggtgcctcatgcctataatcccagcactttgggaagccaaggagggtggattgcttgagcccaggagtgtgacaccagcctgggcaacatggtgaaaccctgtctctacaaaaacattaaccgggcatggtggcacacgcctgtagtcccacctactctggcggctgaggcgggaggatcactcgaacccgggaggtggatctcgccactgcactccagcctgagcaacagagtgagaccctgtcaaaaaaaaaaaaaaaaaaaaaagatttacgatagtaaattttatgtgtattttaccacaattattaaaattgaagaaaatccccatgggtcactggtttaccaatttagccattttcaccatttttagattgcattttccttctctatctcagcattctgactaaaggaaaagcaaaatttcttacaagaatgaatgattctccagtgtggctgctcctgaaaggaacaatgagacttttgttatttcaccacaagactgagaaagaaataaacaagtgataaatgcccagaccccttcttattcattccacatcctggtaatctgaggcatggtgtggcttttactccaagcatatgaatacttacaatcagaagctgcctctcctttccctcactttatcattattgccatcatttatgacaatggagggagtgtctcactggatgatatttggggttctttcttcagtggtccgccataccaagcatttatttgtgctgttctccatctttcacatctaccacttttcaaaagtccctgagagtcaataagacatgcgactcgaacaactgcttcacatctaagtgtatgtctttaaaaatctctccttttccatgtttatgtctgatgtgttttgttatggcaaagtggcatgtagtatacggttcataagtgaatcgatgtatatctgtggagggcaaatgctcaattttagatctacacatgaaagcttttttccagggcaggagccttgctttctccaactaagccttaattacccaaatgcccatgtgttgtgcctttggcttgttgaaatgataccaactggtaaaatctgatgggagataaaagttagatgtccagaagcataaaagtcaggaagagaggctctttatggcatagagaaagctgcagaactgctccatggtgtgcaaaactcatcagcacatgaaactagtgagtggagatagtcaccttcaaccactttgtaatttctaccaattcacttggggccagtgtcccttattcaccaagattcacattggtccttttgattatttggcgtgaggaggcccccagacatgctaaactgtcatgcagggagagaggaaaagttgggaaccagcctttgcttaaaagggctttgacaatggaggcaaataataacattttgggaacatttatataagtaattatataatttctgattcagtagctggttcatgaataaatgagtaattgggagtatctgagtggagacaagaatgaacattaatgtaggactgattctgaattacagcttctggcactagtaggtttcaatatacatagtctgctgaaaggtaattttctctgtgatattcctggtatccctaaggagggaagtataattttaggtacatactgacaaaatttgaacacaaggtacttagatgaaagttatagtctgttttagagatgaaattgaaggatgcagtagctattgctttggcaaaggatttttggctgatgcagtgtatggttattgattttatgattcttatcatatggcacctaatgtatcagttgagttgtgaaaacagtgtttcggtttaatggatgttagggatttatatacaacttcaaatttgcctccttgctaatagtagaaaagagtagtatggaagcattacttccagctgctttttgaagtgtccaccaaaatgaacgactttttcctttcttcacgcagatttcctcctagagtgccaaaatcttttccattcaacacctcagtcgtgtacaaaaagactctgtttgtagaattcacggatcaccttttcaacatcgctaagccaaggccaccctggatgggtaatgaaaacaatgttgaatgctatttatgaaattgggtatcttattttctatcacagattccccaatcttgaggttgcagttaaaaagtgcagctgccaaagagaatgtttccctaactgctacctatagggaaatacactgactgcattttctgtctttttgctgggccgtcttcctctgcttggtctatgccaactgcttacctccacttagatgtcaaataaagtatgtaacaacatgttatgacaggacattttctgtcttagaattgttgctgagaattataggtgggaagtatccccttattctaaagagagatatcagcctatcgatttagaacttgttcaggtagtagtccaaaattggttctgcaacccttaggccctgactcacctccaaccttgtataaaaaaaggctaggaacttatggaagactttagatttgaatatttattatttggagagcctcttcggtgttttatgtgttgcttaccccatggggagtgggaggcctgtccctcatgtcaaggtataatgaaggaggcttcaggagaaccacttagaagactggacaaggtacctatggaacttgggagacactgaccactgcctggtttttatctggataaattttcaaggtcagaggccaaaaggacttctcctgatggaatagcagggggagtgggcaatagtgggagctaactgcactaccattgttaggtgtaaggccaggaaggtcactgaatgggacttgtcttacaaagactctgcctgagaggtcttcctgccaggattagataaccccaatagaaaaagcctgtatgggttgtactgccagaagcagaatctgagaggagagatacaagtgaccagctggagaaggtatatcccatgccaagatcaggagcagtggggtgtctccttgttggcagggagaggtctccaaataactcataagttccctaagaaagaaaggcagaattttggtatgtgtcacaactagggagtactaatgccacattatcactgctccttccaagaaagactttgtcattgtgcctatttgtttttaccctcccccctcctttccacttgctcctaccttggcaggtccagagacacaaaggtgagttggggaggaagattaggagaggaaggtgggaaagcagcgaagctgccaaaacaaattacctttacatattgcagatttctggggctgtcagaatgtagctggagaaggaagggaacttgcaattgcagaagacatcaaaaatttggtattagactggactggacttgttagaacctaagagtgatactgttggttaatacctgaaggttactggaaaagatttgggatcaaccaaagtgcaagaaaagggagatctcacataaagtaattaaaagcagtggtctaagaaaaataaggctattttatgtttttatcccactcaatccagttcattcaacagactgtttataggcattttatacttagtgtattcataaaacagagctcttaattttcctcctgattttctgtcatggcctgactaacaacccagttgcacaagccaaaatcataggagttttctttgactcctctctttttttctatctccacatcatatttatgagcaagtcctgttgactgttcctccaaaacaagttccaagtcttcttattttacttcttgtaaaatccaaattcatccaaattcctgtggcctgcaaggtcctacatgttatgtttcctttttgaccatattttctgttactcctctgctgattcactgtgcttcagccacactttacttgactataccaaacttatttctgcctctggacgtttgcatttgttttatctgttttcaatgctcttccactagatctttgaaaatcttgcttctttttcattagtcagatctctactcaaatgtcacctcctcagagaggcccttcctgactactacactgaaagtatcctctacctcctgcctcatcactttctagcagaccactatcttttatatttataacaacttgaaattttcttatttatttctttatgtgcttaatgtcttgagaatatgatctccattatctgtcttgtttgctactgcacctccagtgcataagacagttcctagaatatagtaggaactctagttgaatgaatgaatgaattgaatgattgccagaaatcttgcctcagagcaaccataaggttaggctgatgttggcagcaagcaaatactactttttgtcagtaattacaggggcatgcttctccactgtgaccttgactctaacttttggaataacaggttttctggagtactatccccaagtaacctttggcggacatctcattcttacaggtctgctaggtcctaccatccaggctgaggtttatgatacagtggtcattacacttaagaacatggcttcccatcctgtcagtcttcatgctgttggtgtatcctactggaaagcttctgagggtgagtaaaataccctcctattgtcctgtcattctatgaatagaacagtgagatgtgtgtgctttgtaatggtggcgttacaactcttttaaggtcctaactgaacattatgtgtatttcttaacatttactagattataaatatctcaagatagggaaatccatcttatttattgctgtgtccttagcatataacatattgcctaccctatagtagatactcaatacaagaatgagggtgtagtggacaccagtcattttttcttcctaaaattaaacatttctcacctgtataccccctaggaattgcttttctgaatatacttcaaacagaacctgccattttcttaaagcccatgcctccctagccatagcagttgatctaggagtgagcagttgacacgggtatcccacctccttggccacagttgattggtccagagatgggcaccttacccaagctaggccaatgagagtacttgcactagcattttgaaatttatgagaaaaaggacctattattaccaggtaatcctatacttaggggatggagcccaaatataataaaatcaagattctactacttcatgtatatcatgtgggccatggatcttataggagtcttaagggggtgttggtcttgtccttttcttagttgcctagctctttgcaggcatggtgcaaaggcaggacaatctacctttatctgctccttctataccactgatcctaccctaaacatgtagctgtataatcagagacaggaagccatggcaaatctggagggtctcggcttggctatatcttaaagagttacatgtattcgtagttcaacattggggaaattttccaaaaattggtggagaaacgagtggccaatgcaattttatctttttttttctgctgacatcagggagagataagagctttaaaatcacaattatggggagataatattttaaaatccagctcaagttaaacccatcagaaaaggtaacaccttttgggacccccaaatggccacatcttatccaatgaggggacaccaaccatagagtctatactgcacagttcaaatggtagccatgagctatcaggcacttgaaatgtggtgagtcctacttgagacatactgtaaaatatacaccagatttcaaaggttaagtacaaaaaagactaaaaatatctcattcattgtttataagtacaagttgaaatgcttatatttggatatactaggttaaacgaaatacattattaaaataatttcacctgtttctttttacttttcttaatgtgactaccagaaaatttaaaattacatatgtggtttgcattatatttctattgaacagtgaaatgtttagcatatgttgaagttgctgctcctgatgcagtggctcatctcagatttggccaagttcttctgtccaaggaaaactaggttcaacccattcctggagaggaacagactcaaatctttctgggctgggtcacttaccttggttaaatctgttctccacctattctaccaacaaccaaagggatggacatagctgaaataaaaatcacgcaatcacactgaatggtatctcacctcaggtgggccttcagcattgcctagccattctactgctacatttcccctaatccatttactctccctctccccaagacagctataatgtttcacacattgttagcctctcattgaacctccaacatgtgctcccgcccctgcccccaccacaacgtgagccttgggaaaaagggtatttttttcctaatgaaatatttcaaacaaagataaatacagaaaataatataacaaacaaacatgtgcccatcacctcactttgccaaatcttaacattttgtcatctttgcttaatttattttacaaaattaagcattttacatacagtctgtactcctctatggggctggcaggaaaaggctctcattgtcaaagttcaaagtaattgatcattgaaaaaataatgatcacattaaaaacaacacttatataatagagatacatattgtaatactcataaatgaaatgatatcctgtctaggattggcttcaaacacatccaagctgatgttacaatcattaggtgaattcctgatgtggaatttgacatttgtatggcgccaaaataatatcccagtgatttttttctgattgtaagtggaaatgttaactttagaatggaggtatcaggctaatccacaggtcagttttagtgtcactaaggatgggatggccagatattatctgcccctgatatggcacaatatgagggactcagcatcatctttgatatattttagccaaaaaacttatttaatttgaatctaatcagaacttaggcatattcaatagcatgggatattctacaggactacaagccaaatttctttcaccaaatgagtgtcagaaaaaaagggactactccatactaaaagagactatgggcctaaacaaccagatgcaatctgcagtcttaggttggattctgatttggaccaactagctacaaaggatgcctttgaggcaattaagaaaatttgaatattgcattgatattaggtgatattaactggatcaggtgtgctagtgtcattttgtttatgtgggcaatttttttttaaagatgacttctaaagtatataggagtggactatcatgaaatttgtaatgtacattaaaatgcatcatcataaaaagtgtgttgaaagaaaaaagtgaaagtagcagtgcaattctaagaataattttctaacatccactcacaaaaatattaaattctttatattaaacacatgaaaaagaacacaaatatatctgtctttcaagattcatctcaaattccacctccttcatcaagcattactgaagagtaggaagcttgtttactttttttatccactgtgttgctcgctccaagggcatagagacttctatcttgatctttatattttcagcttgtagctgagtctggtaaagaataagaactcaataaatatttgtgaataaataggtgaatatttccacatggtattataattatatctttatatgtctatgtcccccaccaaacatagtgttgtaccactaggaaagaacaaagtttaagaaattttcttaaatctctctttcttactgttccgtgaccctcactagtgcctaccaaagagtctgtgacaaagtgtatttgttgttgaattgaattaggcaaaaagatgcaataatggaagcaatttattatttaacagaatgtggagatatcaaccagaacctagtttttactgctcatgctagggttagtgatctcaagatcctctggagtatatgaagcttctccccatttgtggctgctgcttgttagtttttcaaattaagatgcagaaagtaggccgggtgtggtggttcgcgcctgtaatcccagcactttgggaggctgaggcgggtggatcacaaggtcaggagtttaagaccatcctgaccaacatgatgaaaccccatctctactaaaaatacaaaattagccgggcatggtggcacgtgcctgtaatcccagctgctggggagtctgaggcaggaaaatcacttgaacctgggaggcggacgttgctgtgagccgagatccagcctgggcaacagagtgagactccgtctcaaaacaacaacaacaacaacaacaaagatgcagaaagtccgtttcttatgtagaacctattggtgacaataaacttgacatgtttctttgagtgtacagtggatatagaaaggacaattttatttcttcctgctataggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaaggtaagtgtatgaaagcgtaggattgagatgaaataagcagagaagtacaaacaactgaatctatctataacagttagcatttgtgttccttcacctgaaagaggcttttttactctagcatcatgctcatggaaaggagaataatccagtttctgagagaagcagatatgcattctatataaccacaataaactctaagctgggatcaggaggagctgagttccagaattaaatctctctcctcaaagcattgctattttcctcttcaaatctgtgggctttatcagtagtgatttctactgtcctctgccttttgcaaactttgagctaggttccttgaaaacttcatggaggtaaacacatccaagtgtgtgatcaatggcatatagactggttcaggtggttagtttgtcatctgtaaaccaaaagtatataaaaatctaagaaaagtcagcatttatttatatgttactgaaaattaattaatttggattgaattaatatattctaaaataattctaatcaaacctgtttttaatttataccttagcataaattagggaagtaaattttgcataatttgtttttatcctattttttatggtgaaatcagcttcactgtaccttttccttgttccatttatcttttactgcataactccacaatttagtggcttaaaacaacaacagtctcttattatctctcatggtttctgtgagtctcatggaatttgtcagtgttttgacttggtggcctatctaagtgtgtctcatgaggctgtagtcaaacagtggctagagctgaaatcatcccaaaggtgactttattcacatgtctttgaccttggcttgatggtactctccacatgatctctctcacatgggttttacagggtagccagacttcttatatggtcctgagatagcccattagaagctgtttcacgatttctaatgtaaccttggaaatcactcacataacctacattctattagttagaatgcatcactaagaccagtctataaagggagactccaccttttgatggggaataggcaaagaatttattaacaggaatcaccatactctttctgaatggtgatgatgaatgtgattcaaaaaaaggatgggagcggggagtggagaagatgagaaaggtttgtagtttataatagtttcagatgaaagtatgatttctcatatactgagttcagtttcatagtcataattaatgagaaagtgccaaaaccacagtgtattatttatgggatgtaaaggctaatggaacaatgagatcatcaaaacattagtgtttacatatgacatataaagaaataagttaaaaacccaaatgattctttgacacagagttgaactaaagagtctacagaggttctagttccaggtgaaatggataaacacactccaccctttatttcccattgaacttaactataaaaccttgacaaaatgcaaagcccagatatttaaaaatttctaaaaagcaaatagaacaagtatatagagaaaagacactagaattgaaagtattaccaaacttgtgggggagtatacctttttccccactctagtattccttaacctgaattaaaacataactggagacttcgaagtgagtactatgttgcaaagagagctccaggacaaaccctctggggtttcaaggagtgagaaaggtaactctaaatgctcagagagcgtgggaggggaaatcccctagggtttttgtcctcttttccaccattctctcaagcttcagtcccaggttgcctgtggcaatgacagtggctggcaacagaaacctgccggagtaaaaacttagggaggggaacattattcttcattcagtacagctacagatctaagacattgggggaaaagcacattactttctctctgtctttccccttccattgcttgaccttagctatgatgtagttgtggaaattggaagcttctggttagaaaaccaaaaaagggagctcacagaactggaaagtttatagatgacagagagaaaagatcccaggaaagtaaacccataaagttgtgcattaactcctggattcacccccaacctacacatccaggtatgtagtttcagtgtcagatctgttttaaaccccttgcagtgccattgagtccaacgcagtggccagtctggtgcttgaggggaaatctcagtttcacagtcttcaacatgttccattagcctttacgtcccataaataacacactgtggttttggcactttctcattaattatgactatgaaactgaactcagtatatgagaaatcatactttcatctgaaactaacgcccacagaattccttaaaacatgtctgatggctgaaagcaaagatagaacattgtgagataggttttttaatgtatggtagatacaatacataaaagaatcatagcataacaagaggagggtaaggaaaactttatggtccattcaacttcattccaattcaaatggtaaaatgttgactctaagtagatgatagtgaaaggttaagtatgtattttgtaatccctagagcaaccaataaaaaattataccaagagacacagtaaaaagtcacaataaactaattacaatggtatatcaaaaatattcaaataactcaaaagaaggcaagtaaggagagatgaaaatcagagagaagaagcagtaaaatcataataaaatgataggcttaaatctaaacatatcaatacttacattaagtgcaaatggctaaaacacaccaattaaaaacagagattagcatactggatataaaagcttgaaccaattatatgttgtttacaagaaactcatttcaaaaaaatgatataggtaggttaccagcataaagatggaaaaggatatatgatgcaaacatgaatatgaagaaagttgaagtagtacaaatctgtaatcacaacattgatttttgccaggagtgccaaaaccattcaataggggaaagaatagtgtcttcaataaacagtgctgaaacaggtgaatatctgcatgcaaaatactgattgagtatcccttacctgaaatgcttggaaccaagaacgtttcagatttcagatactggaatatttgcacatatataatgagatagcttggggatggaacttaagtctgaatatgaaattcattttggatataaatcccttgccagttatgtgattggcaaatattttctcccactctatagtttgttttttcattcttttaatggtgtcttttataaagcaagagttatatggacaaacatatgaaaagatgttcaacatcattaaccattagggaaatgcaaattcaatcaacagtgatgtatctattagaatagctaaaataataatataaaattgccaagaatcctgtcaagaattcagagcaacagaaagtttcacaatgcacaatggtatagccattctggaaaacagaatggcagttttgctgcttggtagagaaacagtctctggcagtttcttgtgaaattagatgtacactatagagggatagcaggagggagttctttttggatattgaaatggatctgtatcttgacgatgatggggtttcatgagcttatatctttgttaaaagttatagacctatacaccaaaagaaaaagtcaatttcactataattgaaaatttatataaaagtaattagaatgttttaagacagctttatacgtattttaaatgtgtctctaaagtttttaatccagtacttctggtaaagatggcacagggtcttcctacttagccatttttccatcctccacctcaaccccaacctcgctgaaaaccaacaacaaagataggtaaaccataaatagagaaaatcgaataggcatggtcagctgaaaaagaagataaatatttgtggaccagaagcagaacaggaactgtgagtagtaaaaggggtggaaattacaggccaactgagatctgggtcaggaagccagctgcggtagccaaggagtcaggatgacaaggataaatagtgctccccaccagagggactgagagcccatatcatagagttgggctcttcttcacttgaaagagagctgagcacagctgctgctcactctttgtttagggccatggctttgtggaaactcagagtcctagaagaggggaaagcaaacccagtcctagaataggaactgaactaagttttcttggttcagtgggggaatctgcaatatccccaaggtttccattggccagtatctccaaaattccattctagggtatgatttgctagatagagaatagtgaacacatcctttgcttaatcaaccaatgatcacaagggacagcaaagatcactatagttcaacaaagtcagatttattggctcatggcaacaagagactgtggacacctccctaaacaaagggaaatactgtatagagttagtaaagaattttggggaagggtggaggttaggtgatatttaaatgaagcaaagtagagttgtgtgtaaagaaataaccatgaggtctagactgtgaagtgttctaaaaagttaacatagacatgaaaggttaagtcaaggcaccccttacctgaagcttgagctttaaattgagctgcttctttgtgtcaaagtaatttagatgacctaggaaagaatgagatgtttcattcttgttgctattagttcaaacatttctggcaggctgtgaattcagagaacaaacaactcaattgagtaagaaagcaagagataatcaaagcaaatagttggcattcagtgagtttatacagtggcaatgtgtccttgggagaaatggtgttgttaactctgcagttagctttatctatgtctcttatcccagcctgatgagtagcagcacacgtactgttgctttcttagtccaagctaatttttatttctaagcattaagggtgcgagagagagaaagaacggcaaaatgtcataaacaaaaatctttctactcaaaataagcctgtaaacaaaagtttccagtcaaatttaaaaaatatataattctaagaaagatagccaacaagctcaacagttaaagcatgaaacaagctagtttgttccattaaaaacttcagctatcgatatacacggtatttatttaaaatgtgagtataattagaagcactgtgggctattgaaaaaaaatcatgagtatagatgtttaatatggacaattgctattttactcaaaacttttaatttacaattgcagaagtataaaaagttacaagagtaacagaaattatctataatttcactattatcacacagtgtgtgagggcttgtattttgtaagtgtttttaatttttttctttagtaattcatttttatcatattttacacaagtagtggtcttcatcaaagttgaaataaaaaaattctttgctccagatagttttagaaacactgctataggagacctgacatcaaagccaagttatcaagagacagaagactacatttgttcttactgtcaagtaactgatgaagaactgtctcctcctagtgacaatttcctacaatgagattttttaaatagaagataaatgttctcacttctttttcagggagtctggccaaggaaaagacacagaccttgcacaaatttatactactttttgctgtatttgatgaaggttagtgagtcttaatctgaattttggattcctgaaagaaatcctctgctactattaagaggaggtgattatagaaagatcataaattacattactgttcaggaatgaaggagatggggttaaaaatgaattccaagaaaacaaaacgtaacctcagttccactggcagctatgaggtaagaagatagaggagctggataacggactggcctcatccccctcattaagactgtcaacaaatactttgggctctactttctaaatactttctcttatcttcatctattattaagtgcacaacctttggcaagttatttaacctctctgtgtctcggtttcctaaatggaaataatagtacatttttcataagattgttgtgagtgctgagtgatttcacttaagtaacctagagcactgtgtggcatagagtaggccctcaatagtgttagtacctccgcctcttcctcctcctcctaatgtaatcactatgtaatcatagtaacataatattcttcttgcccccttatcaatttacattgccatcttcttaattgaggccctcatgatctgtctcataactctcaaaggaagcttactgaagtgagtatctgatcttgtcactctagcctctacaatacttcagtttgccagtttcggtggctcatgcctgtaatcccagcactttaggaggctgaggtgggcagattgcttgagcccaggagtttgagaccagcctgggcaacagggcgaaaccacatctctacaaaagaattaaaaaatcagccggtcatggtggcgggtacctgtactccagctacttgggaggctgaggtgggaggatcacttgagcccaggaggtgaaggttgcagtgagctgtgattgcgccactgcactccagcctgggtgataaagccagaccctatctcaaacaacaaaacaaataaaataattcaatttcaaggtaaagtgcaaaatgcattatctattctctggtgacatttccagccttgttgtgttccatttcctgccttatcttccatgtcacccaaatatgtaatgctttttcttgcatgagacctctgcatatgcagtttcctctgcctggaaaaatctgtctccctctttacactaagtaagcttctcctttttctttaagtctgacttacttcagttatccccttccttaattccttctcccaggatgacctctagtctggattagatgcctgcttatatttccacagcatcttgagcttattccttatcatactatatcagtattttctactttatttaatatttatcttctttgatctcatatctttttcccttcaagcaaagtgaaatttcttctcctctctgctccctgtaacaccctactctcatctttattatatcactctttactctttattataattatcagcttctctgacgattccagctagagtgtaagcatcttgaaagcagaggctgtatcttcctctctatcatcagtgtctacaattagtagtgctcaataaatatgtgtttgaatgaatgaacaaatgaatggctgcctcataaagttttagcactagctaccagtccttcacacaaaggggtaactccagggagtcactgttcaatagtatttccagtgcttcagcccttatcaatttcagagacagtgttagggagctttcaggttcctggggtttcataaatataagctgggatgaagcaattataacggagacagggactgacagacagcctttttcctaggacaattttcttttttcttttcttttttttttgagatcgagtctcactctgttgcccaggttggagtgcagtggcacaatcttggctcactgcaacgtccacctcccaggttcaagtgattctcctgcctcagcctcctgagtagctgagattacaggcacatgccaccatgcccgcctaatttgtgtatttttagtggggatagggtttcaccatgttggccaggctactctcaaacgcctgacctgaagtgatccacctgcctcagcctcccagagtgctacgattacaggtgtgagccaccgcgcccggcccctaggatgattttcataagctttcttttaaataattcagctaataaaaagaattgaatcctgatgcctcaagctaaccaatattctgtcttctattattatccattcccacttattgtcatggacaaatggagggagagaaaatcagtttgagcaagagatgtctgcctttacataattatcttctccctccctcacactgactttgagaggataagtgctgtgtgcctactttgctgacaaaaatgcttaaggtgtgagcacactgggagcagggaaggagaaaggggaggcggtcattcatgagacacatgcttagctgactctatctttgccttctctctcatcagggaaaagttggcactcagaaacaaagaactccttgatgcaggatagggatgctgcatctgctcgggcctggcctaaaatgcacacagtcaatggttatgtaaacaggtctctgccaggtatgtacacacctgctcaacaatcctcagggtcttccaaattcagcaccagagttctgtacttcagttcacaaacagctcggcatctcagaggatatagcccactgaatacttgaagatctctggcctctggggatcttaatgtatagtaggcaattcctcttttggtcacctgaaaatgaaggcttacccatgtacatacagcccacagtcagatttttctttccttttcttaaatgtgagtgggcaaccaaggatgaacagacatttaaaaagaacctaaaatatggaagggatatgcaaagatgaacaaagaaaataataatcccagaataaaaaaagctatggctcagaacagaactcatcggaagctcttacttctattttcataaagattcaagaagatactgcatcaataaagtaacaataagatgccttccagttttaaaataggggcatagaggcaggctggctttactccctctcacagaaaaccaaaaccaaacatacagcaccaatatctacaccaacaacaacccagagctcacatgtgaggatgagacagttcccggagccacagagaagtgaaaaaactttgagaatcagacttccacatccatgactctccttcctcctattctgcccagcaccaagtgtatggaaaatctcccctcaactcatggtttctacactggaaaaagtgacattgaggtgttcaaccagcttctccaccttcttgggttccctggggggagatttgtccttgccttaacccacagaaaacatcatgactgtctgaaggcagaaatatcccagagtacaggcagagacaaatgagggaggaaggactaccatccccagccctggaaattctgctctataatttggccaaagacatgcaaattcagaatggccgtgcagcagcaccatgctgtagcaggtttatcctacaggtcaccttggcatgaatcactagctggccttccaacactgctatgataatccctttgggacctcacccacttgggacaggcagggctctgaccacttactggaacacctgtaatcccagcacttgagctcagcacaataacaataggagatggctactaccgttaattttatgcagttacgatttaatactggatctttacgtttgtttacatttgtcccaactggcaccttcatcacctccaccctccccaccccagactatggtaaccacgattctactctctattttcacaagatccactcttttagctcccacatgtgagtgagaacatgtggtattgccctgcagtgtcacctatgttgatgcaaatgaaaatattcttttttatggccaaatagtattccattatgtatatataccactgaactgtacacttaaaaatggtaatgatggcaaattacatatgtatattttacatcaataaaaagaaacttaaaaataaggtaacaataggattctatgaaaaacaatcataacaaaacgtgctcataaaaattataaacacaatggtcaaaatagaaactcaatagaaagtactaagaatagataaaatctttcataaggtcaaacaaaatgtggttgagaatatagttgacccttgaacaatgtgggggttggggtactaaccccctgcacagtcaaaaatccatgtataacttttgactccctccaaattcaagtactaatgacctattgttgatcagaagccttatcaataacataaacaacaaatattttgtgtatgtattatatgctgtatattttcaataaagtaagctagagaaaggaaaatgttatttatacttttctctgcttcttgggagtacttccagcatcactagtggcactttatacgggtcccaagtatccttcaaagtttatggagagatgaaatgcttatgcagagatgattagcatcatgcagagttttcagtggatgcctgcagcactcgagctcagcacaataacaataggagatggctactaccgttaattttatgcagttgcgatttaatactggatctttacgtttgtttacatttgtcccaactgggaatggtgccatgtatggttgtaagtatgtaagtttttataaatttcaactttttataatagatttttgtatattttatggtaataaatgataaaatagtctagtatcaacatgtatatgtatatataagtgtgtatacatatatatatatattttttttttttttttttttgagacggagtcttgctgtcgcccaggctggagtgcagtggcgcaatctcagctcactgcaggctctgccccccggggttcacgccattctcctgcctcagcctcccgagtagctgggactacaggcgcccgccacctcgactggctaattttttgtatttttagtagagacggggtttcattgtgttagccaggatggtctcgatctcctgacctcgtgatccacccgccttggcctcccaaagtatatatatatattttttgagacggagtcttgttctgtcacccaggctggagtgcagtggcacaatctgagctcactgcaacttccccctcttgggttcaagcgattctcctgccccagcctcccaagtagctgggattacaggcatgtgccaccacgcccacctaatttttgtagttttagtagagatggggtttcaccatgtttgccaggccggtcttgaactcctgacctcgtgatctgcccgccttggcctcccaaagtgctgggattataagtgtgagccactgcatccggccatctccatatattttttgcattcataacatacctttttcttaatttttttgatatttttaccctatgtggtccatctgacagttttttcaaattgtcataaatttccaaaaaaatctcactatatttattgaaaaaaaactgcatataagtggactcatgcagttcaaacctgtattgttcaagagtcaactgtgtgttttaaagcagattttaacatcaagaaatgatagaaaaatgataagaattaaaagagataaatattcatattagaattgcccatcaggagcttctgagtagctgaacgcatggaggttcctggagagtggctggccccatgccccttcccacatacccttccttatatatgcatctcttccatctggcgtttataagaaaaggtgctgactgctgaattataaggacactgtggtctactagataaaggttgaggagaggggtttgggcttctattgtcttctttccgggccttcatctcctgcttgtgattaagtagtgcatgctgagtggagcaaagtggtggaataggactcttcagcaataatctcctcacagaaacatcaaggtaacaactcgatgcgtgaaattaccttcagaagagttaagaaaacctgaacccatgagcaagactgtgaagcccttttggactgcaaagacgagtaaaaccatagttgcacataaaggggattggttctttatgactgagaccccacccgcaagccactgcagtaccacaggcggaaagtcaccatggacccacggtttttacaccggaaaactctcccgtatggcctgagtgccctctgtggatctccactaattagtagcagagccagcatgagacttgcgtctaacctgggctcagggcgccctctcgtgctaaaaggaaatacaacagccagtcctttcactttctttttgatatggtctctgttgcctaggttggagtgcagtggtgcgatcatagattactgcagtcttgaactcctggctgggctcacacggtcttcccacctcagcctccagagtgggactacaggtgtgtgccactatgcctggctaaattttcgggttttgtgtgtggggtggggaagattggggtattgctatgttgctcaggctgggtctcgaactcctgacctaaagcaatcctccagcctcagcctcctaaagtgctaggttacaagtatgagccaccacactcagccccactcaatttctaaacgagctcactgaaatagagcagtcacaaacaaacccagactgtgaacatgagaataaatacctaattcttcaatgtgtagacagggatgcacatctgcaaagaataagaatagcctaagaaagacagcctcaacaaatgaacaaaaaatcgtgccagtgactaatcctaaagacatgcaggtgaatgatctggtagacaaagaattcaaaatagctattttaagaaaactcaacaaacttttataaaacacagagaaacaattcagaagtttatcaaagaaatttaacagagaaattgaaggaataaaaaaagtcagaaatcctggaactgaaaagtataataaaaaatgacacatgcaatacaagacatcagcaacagaattgatcaggcagaagaaaggatcagcaagctcaaagacaggttatccaaaaatacaatcaggaggggcttcaggatggttgactagatgcatctagtgttcatcccttccatggagaggaaccaaagtagcaagtagataattatactttgaataggtcatctaagagagaacactggaattcaacagagcagtgacaggaagcattgaaagcaagggaggagagagaaataaggcctgtttgcctgggattggctgggagtctggaacagcttcctaatgtggggaaaaggtaagagacccttagtgttcctcattttcaccaaggactcttgcaatcctagccacaggagagcgccttattccttgacagcacagagactagcatagggagttgcctaaagaccgtgtgaaggcattgcaacagagagctcacgctggattctgcaattctcccaagcagctgcagcacagcaccattttgagaacacagcccacacatcctgccctgctatgatggccgtgacttaggcaggagccctgagcagtgatcctgccccacccagcagaggagtgcccatgcattttcacatattccaagaacaaattccactacctacaaccactgctgctgcaggctgctgtggggccaaaacactagtgaaccttgtgctcccaagctacctgcctacagctactccctgagaaagcaaccccaccttcaccaagagcagggctatagcacagctactgctgcaccccaacctgagcattttgctagtgacctcggtatcaccccacccctgcatagcacaaccagcacctcacacaccaccaaggagcctgagggcaggttcacgtagcccagctctacctgcccccagtacccaagcatatcatccaggggcctagggatcacttagccctgtccaccactggtggcacctgagcacctcctggggtctgaggtcaggcccactcaacctgccactactgccacagttagcactcactgcatgcaccacttgagggtctggagactggccatgcgatccatagcagccacaaccaacgccagcacagaccacttgagattcaggttgtttcattgctatgattgccatcaaccatgccactttgctgcccaggaacttgagaacccacccacccatgtgatccatcaataccacttctggcacccaagtaaaccacttggaggcccacaaatcaacctgcctggacctaaaaccagtgcaatcatatgccaccatggtacaccaaagacaagcacactcagcccactgctgccaccattggggcctgaagacaggcctacctggcatcccacttctcagaaaaacttcaccacagcctccactaataaccacaccctaagccactgagaaaatcacaaatatcactgatgctgtttagaatcttatacagaggctactacattcaccgagaatcaaaaccgaagtgctctacccaagcaacaccacagatacatcttcaggaaaaagttctttcctacaaaagcaaattttaaaaattggaaaaagtgattattacaccagatgtgcagatatcaatgtaaggacacaggaaacatgaaaaatcaaggaactatgacactccaaaggagcacaataattctgtagcaagagatccaaataaaaaaaatttaagatgggtacaaaaaaatagaaagaatgaataagacctgctatttgatagcacaacatggtgactatagttaataataacttaattgtacattctaaaataaagagtgtaattggattgttaataactcaaaggataagtgcttgagggtatacatacctcattctccatgatgtgtttgtttcacatcacatgcctgtatcaaaacatctcatgtgttccataaatatatacacctactatgtatccacaaaataaaaaaatcatagtttacaagcaaaacagtatatgtgaccattggtttttaagtaaactggccaacatctctttaaaaatttatgaaatcctggaaaaataattccaaattttgatactaaataaactcagtgagatacaagagaattctgaaaaaaatacaaagaacacagaaaaacaattgaggctatgaaagagaaatttacccaagagatagatatcaaaaaagaaccaaacaaaaattctggaaccaaagaattcattgaatgaaatacaaaatagatttgaaaggttcaacaatagaccggaccaagcagaagagtatcagaactgaaatacagatcttttgaaataacccaatcagacaaaaataaagaaaaaagaattttaaaaaatgagcaaagatttcatgacatattaggcactataaagtgaccaaatatttgaatcttcagtgtcccagaaggcaaagagaaaatgaagaggttagaaagcctatttaatgaaatattagatgaaaaatttccaagtctaccaagagatttagacatctagataaagaaggctcaaaaatacccaaataaatacaatgcaaaaaggtcttctccagggcacattatagtcaaactatcaaaagtcaaagaaaaaaatttaaaaatagcaagagaaaagcatatagtcacctgtaaaggagccgctatcagactaactgtgaatttctcagcagaaactttacaagccaggagagaatgagagagagagaaaaaaaaaaaaaaacacctgccagccaaggatactgtacacagcaaaattatccttcataaatgaaagagagagaaaaatattttcagacaaaaaaaaactgaggaaattcattgcaacctgatctgctttacaggaaatgctaaagggagtttttcaaactgaaagaaaaaggtcctaatgtgtaacatgaaaacatctgaaggtataaaacccacaggtaaaagtaagtatcccgacaaattcagaattctctaacatggtaattgtagaacataaatcacttatatccttagtaggaagattaaaaaacaaaacagataaaaataattaccataacctgttaaagaataagcaatataaaaagatgtaaatgatgacatcaaaaacacaaaatttgggagtcgattttttaaaaaattttcttgcaatcaaaattaagttgttatcagttcaaactaacttgttataactataaggtattctgtgtaagcctcatggtaattacaaagcaaaaatttttataatagatacactaaaaataaaaagcaagggattaaaacatactgatagaagaatcacttaaccacaagggaagagattaagagaggaagaaaggaacaaaggatctacacaacaactagaaaacaagtaaaaatatggcactaccaagttcttacctatcaaaaattaccttgaatacaaatgggttaaattctccaactaaaagacatagagtgtttggttttttgttcttgcgatagtttactgagaatgatgatttccaatttcctccatgtccctacaaaggacatgaactcatcattttttatggctgcatagtattccatggtgtatatgtgccacattttcttaatccagtctatcattgttggacatttggaccgcatattctcactcataggtgggaattgaacaatgagatcacatggacacaggaaggggaatatcacactctgggaactgttgtggggtggggggaagggggagggatagcattaggagatatacctaatgctagatgacgagttagtgggtgcagtgcaccagcatggcacatgtatacatatgtaactaacctgcacaatgtgcacatgtaccctaaaacttaaagtataataaaaataaaaataaaaaaatttaaaaaaagacatagggtggctgaatgaatttttttttaaaaaaagatctaactacatactgcctaagagaaagactttacctgtaaggacacacatagactgaaagcgaagggatagaaacagatattccatgcacatgtaaacaaaaagaaagcaggaatagctatacttatatctgataaaatagacttcaagtcaaaaactataaaaagagacaaacagccagacgtggtggctcatgcctgtaatttcagcactttgggaggctgaggcgggtggatcacctgaagtcagaagttcgagaccagcctggccaaatggcgaaactccatctctactaaaaatacaaaaattaaccaagcatggtggcaggcgcctgtagtcccagctactcgggaggctgaggcaggagaatggcatgaacccgggaggcggagcttgcagtgagccgacattgcaccgctgcactccagcctgggcacacagcgagaatctgtcaaaaaaaaattgacaaacaaggccattatataatagtaaagaagttaatacaacaggagaatgtaacaagcataaatatatatacacccaacattggagcacctaaatatattaatgtttgatctttgtattttctagtctcattaaaagtaagggcaaaaactacaattacttttgcaccaacctaatataaagcaaacattaatagaccaagggggaaatgaagacagcaatgaaataatagtagaaaactttaacaccccactttcaccaatggacagatcatccagacaaaatatcaacaaagaaacactggacttgaactgcactgtagaccaaatagagcaaacagacatttacggaacattccatccaacagctacacagttcacattcttctcaactgcacatggaacattctccaggagattatacattaggccacaaagcaagtcttaactaacttttttaaaatgaagtatttttttcctgccaataatggaataaaactataaatcaacaacaggaggaacaactgtacaaatacatggaaattaaagaacatgcccctaaacaaacaatgggtcaatgaagaaattaaaggagaagttaaaaaatttcttgaaacaaatgaaaatggaaacataacatgccaaaacttatgggatacagcaaaagtagtccttaaagaaaagtttatagcaataaatgcctacatcaaaaaaaaatctcaaataaacaacctaatgatgcatctcatggaactagaaaaacaagaacaaacaaaaccccaaattattagaagaaatgaatgaatacagatgagagcacaaataatcaaaatagaaactaaaaaatacaaaagatcagtataatgagttagttagttctttgaaaagataaaaaaaagtcaataaacttttagccagactaagtgataataaagaagaaaaacagaaataaatcagacatgaaaaaggagacattacaactgataacacagaaatacaaagaattataagaaactactatgaacaactataagccaacaaattgaaaagcctagaagaaatggataaattcctggacacatacaacctaccaaggttgaatcaagaaaaaatggaaattttgaacaaatcaacaatgagcaacaagattgaagcaaaaatacaaagtctcccatcaaagaaaagttcagtacccaatggcttcactgctgaattctaccaaacatctaaagaactaataccaattcttcacaaactattcaaaaaattgaaaaggaagaaactcttccaaaattattttaggaggataatgatcattatcctgatcccaaaaccagacaaaagcacaataacaacaaacaactacaggccaatatcctcaacaaaatactagaaatagaattcaacagcacattaaaagatcatttaccatgatcaggtgggatttatcccagtgatgtaaggatggtttaacatatgcaaattaagaatgaaggacaaaaattatattatcattttaatagacacagtaaaggcatttgacaaaattcaatatcccttcatgataaaaactctcaacaaagtatagaaggagcatacctatatgataaacctacaaacaagatgaaactgagtggggaaaagttgaaagcttttcctttaagaactggaataagacaagcatatccaccctcaccacttctattcaacacagtactggaagtcctagccagagcaattaggcaagacatccaaattggaaagaaggaagtcaaattgtccctgtttggccaggctcaatggcttatgcctgtaatcccagaactttgggaggccaaggcgggcagatcacttgatgtccagagttcgagaccagcctggcaatatggtgaaaccccatctctactaaaaatacacacacacacacacacacacacacatgctagccagacatggtggtgcgctcctgtagtcccagctactcgagaggctgaagcaggagaatcactagaaccccagaggcggagcttgtggtgagccaagatcgcaccactgcactgcagcctgggcaacagagtgaaacactgtctcgaaacaaaaacaaaaacaaacaaaacaaattgtccctgtttgcagaagacatgatcttatatatagaaaactgccaaaactacaccaaaaaactgttagagctagtaaatgaatgtagtaaacttgtagtctacaaaatcaacatacaataattgatagcatgtctatatgccaacagtgaacaatctgaaaaagcaatcaagaaagcaatcacgtttacaatagctacaaaaaatgtccagaaataaattaaccaaggaagtgaaagatctctataatgaaaactataaaatattgatgaaagaaattgaataagacacaaataaatggaaagatatttcatgttcatggattgaagaattaatattattaaagccaaagcaatctacagattcaatgcaattcctatcaaaattccaatgtcattcttcacagaaatagaaaaacaatcctaagatttgtgtggaaccacaaaaaatcccaaagagccaaagaagtcttgagcaaaaagaataaacctggaggcatcacactacctgatttcaaattatactacaaagttatagtaaccaaaacagcattgtgttgacataaaaacagacatatagaccaatagaacaaaatagagagcccagaaatacacccaaacatttaaagccaactgattttctacgaagttggcaagaatacatgatgggtaaagaacagtcttttcaataaatggtgctgggaaaactggatatccatatgcaaaagaatgaacctagaccccctatctctcaccacgtatgaaagtcaaataggccaggcacagtggctcatgcctgtaatcccagcactttgggaggccaaggcaggcagatcacttggggtcaggagtttgagaccggcctggccaacatggtgaaaccccgtctttactaaaaatacaaaattagccaggtgtggtggcacacctgtagtcccagcaacttgggaggctgaggcaggagaatcacttgaaccccagaggtggaggctgcagtgagcctagatcgtgctattgcactccagcctgggcaacagagtgagactctgtctcaaaaaaaaaaaaaaaaaaaaaaaaaagaaagacagaaagaaaagaaaagaacaatagattaaggaattaaatttaagacctgaaactctgaaattattagaagaaaacatagtgtaagcatttcatgacatcaatttgggcaagaatttgttagacaagacctcaaaatcatgagtaacaaaagcaaaaataaagaaattggattacatcaaactagaaagcttctgcacagcaaaggaaacaatcaacagagtgaagagacaacctatagaatgggagaaaatatttgcagattatacatctgacaagggattgatatctagaatatataaggaactcaaacaactcaatagcaaaagtccaaataatcctattaaaaatgaacaaaagacctgaatagacatttctccaaaagagacctacaaatggccaacaggtatatgaaaaatgctcaacatcactaaccatcaggaaaattaaaatcaaaactacaatgagatatcacttacccctgttagaatgactattataaaaaagacaaaataacaagtgctagcaaggatgtggagacaaagaaacccttatacactgttggtgggaatataaattagttaagccattagagataatggtatagagatgcctcaaaaattaaaaatagatctatcatattttctagcaatcccactactgggtatataccaaaaagaaatgaaatcagcatgttgaagaaacatctgcatccccatgtttatgacagcattattcacaatagtcaagatataaaatcaacttaaatgcccatcaatggatgaatggataaagaaactgtgatatagatacacaatggaatactattcatccatttaaaaaagatgaaatcctgtcattttcaacaacgtggatgagcctggaggacattatgttaagtgaaataagccaggcagagaaagacaaatactccatgatctcagtcctatgtacaatctttaaaatttgatctcatagtagttgagattagtgattctaggaagataagggggaagtgggagatggggagagattggtcaatgggtacaatgttacaggtagatagaaggaataagttctggtactctattgcacagtagggtgacaatagccaacaataatatattgtatatttcaaatagaagagaggattttgaatggtctcacaacaaagaaatgacaaacatttaaggtgatggatatgataattaccctgatttgaataattacacaatgtatacatgtattgaaacatcacattgtacccataaatttgtagaattatttatgtgtcaataaaaagtaatacagttaaaaaaataaaattgcccattaggataaataaaaagacccacacacaaaattatcattgtggcatttcagagcacagagagaagatacttaaagcttcttctgagaggaacaggacgcatacaaaagaatgggaattagactggcgatataattaagcaatattgtaaaagatctaagggaaaaattatttggaacctagaatttttagtcaaactatgaatcaattttgggggaagaaaaaagacattttcatatatagagggccttaatagtcactgaatgtgtactatagtaaaaccagaaactacataaaagaggaatttgggagattcagcaacccaagagaataatgaagtatgagggggatgttttctccttagttcttttccgtatttttcaataatttgataataaacatgcataattttataattaaaaaggaaattaattttgacaacatgcaagttcctgttctcacataccttatagtggagggacagattgtagtcaaataagcataataatacatgcaaaattacaaactgagcattactctgaaggaaaattacataattctatgtaagcctataatacaggaatctgacctagactggggaatcagagaaggcttccctaagcaagtaccccttgaacttagctttgaaactgggaaaatgaggcaatgtgagatgaagctgttagaggtattaggaatcaaacctattggggccttctagtccttagtagagagtctggactttattctatgtggaatgacagcctccagtgggttttaggctggcggatactacaatcagatctggaatgcagaaatagtacaccagtttctttgtgggtaaaagtcttagaggggagaatatgaccaactgtagggagacctgtaaaaaaagtttatcagtagctcagacgagataatggtaacttggattaagatagtggtagtagtaacagtgaaaaactagatacatttgaaagcttttagagccaaaataggaggcagctgtgcccttgttgttaccagtgtgggatctgaacacatgactacttgggttcaaatactgagcaaattaattaacctctctgggcatccgtttcctctcctgcaagacatggatgataatggtttctacattcatagggttgttatgaggaatgaatgaattaaaacttgtaaaatactttggacagtgcttgacataaaacaagtgctcaatacatattagctattattgattatattgccctggtcagtgtcaaactgcatatgggagatgagaatggtaacaaggataactctcacttgcatattcaaatgcaggatgctgccattcactgttataaaaaactctggaagagaatgaagtgatgaaaattgtaaatttggttttgaacatgtgggttttttgagatatctaggtggagatgttgagaaagtgattggctgtatgagcctggagttccagaagaggtcagcaggggagacagaagaaggagcagtctgagaagtaggagaaaaaaacccacagagatgttggcacagaggccaagggaagagagagttttaaaaacgaatgaatggtcaacaggtgcaaataaagactgaaaaatgtccattggatttagcagcatgatggtgattggtgaccttggcaagagctgttggtttgatagtagcccaatgttcttgataaatttgtttacaagtcaaggtagcaataaagtgtctaaagtcaatttgtccattctgtcctagcaagtgttttccatttcagattctctacttcatagccataggtgtcttattcctactttacaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatggtaatatcttggatctttaaaatgaatattataaatatccagtcctacttttaataaaatttactggacaatgtacaggaatatagtgtgttgctgaaggggacattatagagttactgtattagacctcagccaagatcccctagtttccagcttccagtgtaaagtttttaccttgactataaaagggcttgagtattagtaggactcatggatttttagttaaatgtctgtgatggagaaaagatggcttatggatgattgaggtgggaaaatgaggagaatagtatgcccttggtttctcagccttatcccattaattacgctccaatattatggagagaggaactgcaagttgtagctgaagagattttttttttttttggagaaatctagggaaatgggaaaaaaaggcattgtccagattgcaactgtaagggctccactatatcattagtaatgcccagagcagtaaatagcaaatatgacaggctattgtagagcttgacttcagacaccagacagccagaggcactctgtagatacctggcagtagatgagagacacctgtgaaactgagggcaggtcaggagctagtgaattttagaagtaacatgggattgaaaggactatttggtgggaactttggaaagggtcaaaggttctgtgtaagcaaattaggacgatggtaactacagttttaaattattgttaatgtaactttatttgtaactgctagttgtgcaaattcagattgcatcatcatttcaccccaattttccttacttttgtatttattctgctaactcttaatcttggatcaacctaataaccctctttctctacccctctcgtggccattgaaggctcttagtcagtttgtgctgcaataacagtataccacagaatgggtaatttataatggacagaaatttattggctcacatttctgggggctgggaggtccaatatcaagttgcctttttctgcgtcttaacatggtggaaggcattatatgacaaaagggcaaagaaagggtgagagagagcaagaggagggtgagctcactcctgtgataacaaatccactcccatgaacactttccccagataactgcattagtccattcatgagggtggaacgcttatgacctaaacaccttttatatgttcacctctcaataccatcacgatgataattaaatttcaatatgagtttcggaggggacagacattcaaaccatagcaagagttattggagaaaaatgtcggagaggcctaatcttttatatttaatagcatttctttcttcctattactctcatattaaccttctcctcaggttccttggttgacttagaaaagagaattgatcttgccatgcatccaccattttcctccttatgttctattagtgaccttgtttattgtcttctgtagtgattaagaatagaaatctctcttccccatgtgtcacataatatttatggaattttgacaagaccttagtggacaaaatgtgtcatactgaatgagtaacaggaagttgatgcacaaacaacattcttgcaggcacagaggaataggtcatttacttgtatatgatcattgtcaatcaatcattgtccagttggaccccgattcagtttattttttgttttgtttttctccttttcacagattctatccactaattttaatctttatttttcagaaaaaaatgctttatcttattgaacctcagaccaaacactttgtttttcgatgcagactgagttatgtttaaggctacatgaaccccagactagttgtttgctgctcctaaaaccttccctgttcctcataatcaagtaaacaggtctcccttcttagaagtatttgatcttcaaaattgccctgtggtataaatagggcaggaattattattatccattttacaaagcatgaagatgagactgagaatgttgaatacatttgccatagggtttacaactagtcacaggcagacatgctcttaaaatatatatctccttgattttaagttgtatcttgtcatggttttatgaacttggaacatgtcttaaagtttatatctacactaacatttttcccaataagctgttattaaatcaatgatttgtggcaagaagggatagtgatgtggaaagggggggtacttaggggagagcctggaaggcctaataagagagaaagaagtcataaaagttaaggcaagtgatatggtttggatatttatcttcactgaaatctcatgttgaattgtaatttccaatgctggaggtggggtctggtggcagatgtttggatcatgggggtgaatccctcatggcttgatgctgtcttcatgatatttggtcattcagaagtgtgtggcaacttgcactctctgtcttgctcctgctttcaccatgtgacatgtctcctcccccttcacctacccccatgattgtaagcttcctgagacctccctgaagccaagcagatgccagcaccatgcttcccatatagcctgcagaaacatgagccaattcaatctcttttctttataaattacctagtctctggtatagaacagcctaatatagcaagacactctgacattgtttggtttgtctgactccagatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacaggtaagcactttttgactattggtactctctcttccccatactcaaaaagttcttaccagttattcaaaccaacaaatcctgaagccatgtttaaggttaggtacaggtatggaatcaaatggcaagggtattaacatttggaaactaacatagctgagcatcagagaagcttgtatttttctcactccttgccttgattgaatcatataagctgttttagagttggatttgagcctacctagaatttttcttcccaacctctcatctttttttctcttatacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttggtaagttgaagaaaagatttaaggtcaggtaagaagaaaaagtctggagagttttgagtttctaaaatacctcataattcagccttgtctccaatggacatgatcttttaaaagctataaatgttacacaaataatagctgattgtatgtatttaaagtttgagtatatagaataaaaatttaatgtcacccactaaactcgacactcctttgaaatactgcttagactttgatacatatccttccagatctttctccattaattatgtcatataggagtcagcagactatggcctgtgaaccaaatttggcttgtggcctgcttttgaacagtccatgagcttagatgagattttacatttttaaaatattgcaaagaaaagaaaggaggatgggaggaaggggaggagaaggcggaggagcaagagaatatgtgacagaggctagatagggctcacaaattttagagtacttactatccagccttttccaaaaaatgcttgcttgctcctgatctaggatattaagaatgagtatggtgtaagtaacagaatactcaatggacagtggtttaaataaataagggtttattttcttcacaagaaatttgaagattggtcgttggttccataaattcagccgctgaagaatgtcatgaagaacactggtttttagatatggagttttgttagatactgccaaactgactttcagcaattttgtaccaatttatatcccctaccataagtatatgactgcccttttccccacaccattgccaacaacatatattataaaccttcagaaaattttccaatttgatgagcaaaatgtttatatgttgtcttcatttgcatttccctggttagtggtcaaattgtatattgtttcatgtttgttggctatttgtataactccctctgtgaattgcctgcttgtaaattttgtccagttttctatttggtcagtcatcttttgcttatgtatttgtaaaaggtctttatagattatggatattgacacattgttatttatctttcaaatgttttcctcacattgtcacttgtactttaactcctttatgatattttttgtccttcaaagatttttcatctttatatagtcaaaacctcctatcttttatcaatcttttcatttatatgtctctggatctttttcacttatgttttctgcctgagaatgtctttgccacccccaagacactacaaaaatagtctatattttattctcttacttgtatagctttatttttacagtgagcaatctaattgccctggaagttacttttgaatgtagtgcataattcaaatagaaattttcccaaatggcagctgacacaaccaatccttttttcattaatttgaaaatgtcttctttatcatatactaaattgctaaaatctgggatttttaattctccttaactaatctgttaccaccctgttttaatgacttcaactttgtgatatgtttgatatctgtatgacatcttctttcattgtacttcttcaaaatttttattagctattattgtacaatttttcttcataaattttgtgtacgtattttttctatttttcattttttgaagattgtataattttattttttattcattaatttttaaaatgcataatgacacaataattttacatatttatagggtactttttgtgtattttgagttacttttactggctaatttaaaaatagataaacaagagcatgcaataaaatgtaaattttcctccctcttggacttccaaccccatagtctgacagacagtcattgctgtgggtttgtatactcccctccagaagtagtgcatacatgtacaaatgtgtgtgtgtatgtgtgtgtgtgtgtgcatttcacacaaaaacaagagcagtgtaaattggtctgtaccttgatttttaaaaggtaacaatatattttgaattagccaggcatggtggcacatgcctgtagtcccagctactctggaggctgaggcaggagaatcgctcgaatctgggaggcggaggttgcagtgagctgagatcgcaccactgcactccaccctgggcaacagagtgagactctgtctcaaaaaaaaaaaaagtaacaatatattttggatatcatttcatgtcaacatatatagatctaccccattctttgatttattcaggttatactctggataccatgctgaatcctacacttaaacattacctcaaaatggatcaaagataaaatgtaagagctaaaactacaaaattataagaaaacaacaggataaatctttgtgatcttgaattagacaatagtttattggataggacaccaaaaccaacaagcaacaaaagaaaaaccatttgacccagccatcccattactaggtatatacccaaaggaatataaatcatgctgctataaagacacatgcacacgtatgtttattgcggcactactcacaatagcaaagacttggaaccaacccaaatatccaacaatgatagactgattaagaaaatgtggcacatatacaccatggaatactatgcagccataaaaaatgtccccgtttgcagatgacatgattgtatatctagaaaacaccattgtctcagcccaaaatctccttaagctgataagcaacttcagcaaagtctcaggatacaaaatcaatgtgcaaaaatcacaaacattcttatacaccaataacagacagagagccaaatcatgagtgaactcccattcacaattgcttcaaagagaataaaatacctaggaatccaacttacaagggatatgaaggacctcttcaaggagacctacaaaccactgctcaacgaaataaaagaggacacaaacaaatggaagaacattccatgctcatggataggaagaatgactgggttttaagacaagagcagaagtggaagttgcatttttatcctcatatcacacacctcagatctggaggtgggattgatattttcagggttcttcgctgcagcttccatgttattgctcttccattctctctctctctctctctctctctctcgtctctgtctctctctctctctcttgagatagggtctcattctgtcacccaggctggagtgctgtggtgtgatcacagctcactactgcagcctcaacttcctgggctgaagtgatcctcccacctcagcctcccaagtagctggtactataggcatgcaccaccacgcctagctaatttttttattttttgtagagatgaggtctcactgtgttacccaggctggtcttgaagtcctgggctcaaacgatcctcctgcctcagcctcccaaagtgctggcatgagccactgcacctaggcctttgttttcttttaaagctggtgcaatcaggcaataccacctgctacccttgcttaatactgtaatcaactgtcctcttggtcatgcctgctcatgcactgaagattttatctcctgaaacactgtctctttctctattatcagtgaatttaatgcccaaatagtaataaaggctgagaggaagcagtgtcctcaccaggcatctaaatttcaattagtgtgagaaggtgcagagaatacttcctgaagcaattgaaacaatttttaaagaagtggaaaggggcctttagagagaaacctaagtactgtcagccctctacattgtcaactgaagaatcctaagtttgtaaatttggagtggaaagggttgcaggctgggaagtgtagcctctggcagcaaatggaagcaagcactttgaagaaggaaggatgagataagaatttatgctgaatgagttggctaagtatacatatttaacaggttccaggaggagctgtgaatatttatgatggggcacctgcaaccacacatgttacatacattccatgttcactttggggtggagacttaacatttagatgcatgaaaattaggctgtatatgtcaaaagatgaaacagaggacacagaggcagcctctgtaaactggccagagccagtccatggtcagtggtctctcatcaggaagcaatgcttctcggttgttatgataaaactgcacaaagggaggggaatccaccacgtctttagaaaggactggtttatgtttaacccttaagaaagaaagtctaacggcagattagggagggagggaatgtaacaaggcatgcccgatctcccatcccatcatggtcagaaactcagtttttaagccatctctggggtctccttggccgagaaaggggtctcttcagtcgtttggggatgcttaagattttatttttatttttcagtatcactggatttctagtctcatattcaaacaaccattgattgaaagtattcaaaaaacaaccccaaaacaataaaagataataatacaacaataaacaataatacaaagaaacaatacggtaaaacaactatttacatagcatttatgttatattatgtactgtaagaaatctagagacgagttaaagtacatgagaggatgtgcatatgttatatgcaaatactacatcattttgagtaagagacttgagcatcacagattgtggtatctgcaggggtcctggaaccaatcctccatgcatgccaaggaacaatttcatgaaaagaccaaatattttgagttttatctagcctcaaattactataatgtagatagaggccacttttatttatctggagttagaccacagttttcttgttgatcctagtcgttttaggatttgatcttagatctcgcttatactttcagattatatttaagaatcaagcaagcagaccatataacatctaccctcacggaatcactgatgtccgtcctttgtattcaaggagattaccaaaaggtaaatattccctcgatttatagctcttttttacctgtagatacagatgagataaatatcatcaataacaactaaaattatgttggtcctttctccagctgttggccggacctcaagctccagtctaaagttataaaaatcaattataggaatcctcaggtgatgtttcatgtaaattcgtgaagagtcgcctgacatgtttttcctattacctagcggtgatgttcaaatattccacagccaattagattccactgcaattggttccactgcaactactgtaaatgccctaaaatcttgaagctggttcttctggcacttaagataatttttttttctgagtacggttttcagctacattccacacttttggtatctagtgtggtattccacactttgggtaactagtttgatattttcaggattctttgctgcagcttccatgttattgctcttccttgctctctctctctctctctctcaacagggtttcactctcacttttggtatctagtttgatattttcagggttcttcgcatattcatttctaaatagttcacaactccagtttttatttactatattgtttgctgtttaaagatttattttttcttttagtagattggatgttatgtatattctttctattatttaattttggatgaatatttatcaaaataatagatgtgtatgcttaaaactacaaaagggctgcctccctagaggcatccatttttaagaatttctgtttttgatttttggtggttatctctacatctctaaaaagttacttatactgctaactctttgtttttcaactttagacattatatacttactttgttttgtgcttttttccattcaagttgtttcagttttatcagtgttttcagttggattggctatcattagaactttaaaaatatactaaacatcaacttttagtaagatattttccaatcatggattgaaaatatcttttgactccatacttcataaattaaggatattaaaaactgtacccctcacttttcctttccccaaacctttcttttctctactgctgctagccattcctttacttttacaaaactaaacttgataacatttacattttgtgctgtaatttgaaataactcttccttgctttgtctatatattttctctaaagcttaaaaaattaaaaaacagcatttgtattattttagtattttagcaagtttcttttcataaatgttaactgcagaactgggtaatatgctatgattgctctcttttctacagctcaagtgattttactattaagataaaataatatgtggaaggaaaaaagttgatctcatagaagtagagataaaatagtggttactagaggctaaagaggggaaggggagggggaaatagggagacgttggttaatggatgcaaaattccagctagataggaggcataagtcctaatgttctatagcactgtagggtgactgtagtcaacaatgacatctattttcaaatagctagatgagaggatttggaatgttcccaacacaaaggtgtatcctgaagtaagactttgttttcttttattcggaaaagaaatgtaggcttcttcaaccctatttcttaggcctttcagcttcttaatcattctatgtattgcttgctatccaaatcttttattttttttttgagacagcgtctcgctctgtcacccaggctggagtacagtggcacgatcttggctcactgcaacctctgcctcccaggctcaggctatcctcccacttcagcctcctgagtagttgggaccacagacgcacactaccatgcccagctaattttttttattatttttattttttgtagaaatggggtgttaacttgttgcccagactggtgtcgaactcctgagctcaagcgatctgcctgcctcagcctcccaaagtgctggaaccaaatctttttcttcttaaagacattcttgtagtgaatagcattaactacttttcccttgtacatttctattttttgatttcttcttttgtttttctggaagtatattctcaagtaacttctaaatatgtggtacatagagggtgaactttctgaatccttcagtatcacatgatgggcagacagactggttataaaaattttcccgctgggtgcggtggctcacgcctgtaatcccagcactttgggaggccgaggcgggcagatcacttgaggtcaggagttcaagaccagcttggccaacatggtgaaaacccatctctactaaaaatacaaaaaaaatagccgggcattgtggcgtgtgcctgtaatcccagctactcaggaggctgaggcaggagaattgcttgaaactgggaggtgaaggttgcagtgagccaagatcaccccactgcactccagcctgggcaacagagcaagactgcatctcaaaaaaaattccttcccctgttttctaatattcattattgccgataagaattctttatttgcatttctttatggaagaatggcatagtgacagagttctggggagattttgaatgtgtgtcccgaaatttggaggcatacgtggatagttactggtaacctgcttttccatggagaattttgaaggctgtaatgcccataatagtgggcaagaagagagggcaagagtggagcagtttaccttcctgctgtttgacatgagtttattctgtaacaagtgaatactgttgaaagtagctgggctttatcccttttgaagatattctacccaagaaggcagttaggcaggctgaggggatagcagaaccaatagagtcttggatatatcactggaagtaagaagagctgatggggagaggagagttgcagaaggatagctgaaagaaacatctctcatgtcatggaactatgtaatgctgaggtccccatggtaactctaaagaaaccatacatgtgtcctatgaaaagaccagcatttgggcacctcccacacagagaacattgatgaccaaatagtgttgtcaaagatagagcagcaggacctgttaaacaagagtctgtttgccctttcttctattacctaccctccctcacccccagctcctggaaaagggaagagaaggctcagaaatattgaaagaacatactacaccattccctttctttctttctttcttttttttttttttttggagacagagtctcgctctatcccccaggctggagtgcattggcatgatatcggctcaacctctgcctcccaggttcaagcaattctcatgcctcagcctcccaagtagctgggattacaagtgcctgccaccacacctggctaatttttgtatttttagtagagatggcgtttcaccatgttgaccaggctggtctcgaactcctcacctcaacaccattccctttctatggatcctctaaccataggtcaggcataacttactgaggtgaggaagagcttagaatgaatataaaattaaaattttgatttagattgtatcttcaggtatgaaacatacccagaatgagacttaattactaaaatcagttcttgtcctgaggacccattaccctgagggcagatctcagttcttgctccctttcctcacagaagtcagagactacaccttaaaactccaatgccaagctctttggcatatattcaggcctgacactttcacagtcaaccggataatcaattacagctttttactttttaaaaaaattgtttgaatcttaaaattataataggtgcgactttagcttccacttgctcagaaacttcatatgtacatacagatttgtagaacccttgcaacaacaacatgattatcaatatgtggcttgttgtactctaattgagctatttatggttttgcttgtgggtaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccaggtgagttcttgcctttccaagtgctgggtttcattctcagtgtatgtccccttataacctgaagaaaatataatggtttgcaatataggtcagtaaaagaaatgagcttagcttttactaaatttgagtttcacgtagtaaacgtgcctgctggatggataggccatagaatgtaggccctagatttttcctatagtactcattcccagtctgggatttagctctctctagctgatcctccccatttttatatgtccaattaccacctattttcagatgacccacagatttatatctacagcctagatttcttccatggacatctcattatgggtgactcaaaagtacctcaaaattaacatgtctgcagcatgtagcactgttgcaggaagtcagggaccccgaacagagggactggctgaagccacggcagaagaacataaattgtgaagatttcgtggacatttattagttccccaaattaatacttttataatttcttacgcctgtctttactgcgatctctgaacataaattgtgaagatttcatggacatttatcacttccccaaccaatactcttataatttcctatgcctgtctttactttaatctcttaatcctgtcatcttcataagctgaggatgtatgttgcctcaagaccctgtgatgattgcgttatctgcacaaattgtttgtaaagcttgtgtgtttgaacaatatgaaatctgggcaccttgaaaagaacaggataacagcgatttccagggaacaagggagataaccataaagtctgactgcctgcagggccaggcagaacagagtcatatttctcttcttgcaaaagcgaataggagaaatatcactgaattctttttctcagcaaggaacagccctgggaaaagaatgcattcccagggggaggcctctaaaatggccgctctgggagtgtttatcttatgcagttgaagataagggataaaatatgccctggtctcctgcagtgcccccaggcttgctaggattaggaaattccagcctggtgaattctagtcagaccagttctctgctcttgaaccctgtttcctgttaagatgtttatcaatgacaatgcatgcacagcaggacatggaacctcattagtaattctaatttcgccctaccttgtgatcttgctctgtccctatttgccttgtgatattttattgcctttgaatcatgtgatctttgtgacccacaccctattcgtacactccctcccctttgaaaatcactaataaaaacttgctggttttgcggcttgggggcatcacagaacctgccgacatgtgatgtcacccctggagacccagctgtaaaatttctctcttttgtactctttctctttatttcccagaccggccgacacttaggtaaaatagaaaagaacctatgttgaaatattgggggctagttcccacaatatagcacagtgcatctcacttagtaagagcttaataggctacgtgcggtggctcacgcctgtaatctcagcactttgggaggccgagacaggaggattgcttgagctcaggatttcaagaccatcctgggcaaaatagtaagaccttgtctacaaaaaaaaaaaaaaaaaaaaaaaattagctgggcatggtggtgtgtgcctgtagtcccacctactcaggaggctgaggtgggaagatagcttgagcccaggaggtcgaggctgcagtgagcctggatgacaaagcgacaccctgtctcaaaaaaaaaaaaaaaaaaaaaaaaaaaagcttaataaatacttttgggcaaaacatagggaaagatataaaatatttcaaaatatggctagaatttggaccatttctactgctttaaaaaataaagctaaattctctgaacaagaaaagcttagttcttcacaaaaactcattgctcggccccagaataactcagtgccatattgctgaggcttgactacatgtccatttgattatatttatgatacataagatccctactagtctgaaaacatttcatatgtttagagagtaaagtatatgaactttggtgccaataaaacacatggcacataaactcagagaagtataaattttgccaagtacttgtcctgaccgatttttcctaactatagttttttcgtcacttttgggaagagaactgaaatattattctatattctccaatctcctctcttcagtattttggtttatatagctataggttataaaaaatgaggtttatacatattagtgaggtttacatatgaaatcttagcagatccaattagcaagcgactaattcataaatctggttcatatacaaaatgctcttctgaaaaaaatttgaatgttttaaacagaaaatttaaggtattagtgttgtttgacatttttgtggttcaccttatctttcttatttgatttctgtttttctatttttaattttttatagccttgtggaaggtcagttgctagatggaagtttaggaaagtcagtatctcatttgacttaactaacttaagaaaggcactgaataaccacttggttctttaaggagttaaatcttctaatctgaacatgaagagaataaggctacagactgtaccaaataaatcagctagcatatggccttgggtgcagaaaaaactaagttcagtgggatcagtcaccctcttgtcctggggacacatttgttgtaagcatatactcactgctcatagcacccaccctcaactcccaagccctggtacatgcctaagaggaaatggaattaaaccaatggattagatatatcacatgcatgccatcgctttcatcatagactgctagctcctacctgacaacatcagtagcatttctttacccctttcaatatatgtaattaacagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagtgagtaaagcagcacttaagtccagtgggtggtgaataaagaaaaattgatgtaatcaaagtgatgtccagataatgaatgaattgtatgtgcacataaatttaacaattatgttacctataaatgtataatttttactcaaacacacgtgatcatataacccatattttaaaaatccagtcaccattttttcctttcaatatttacttgatttccctctcccttttaattccctatctccttctatattacatcttttcaccaaccattccatgcccaggtaacatattttaagacatattttctctataattatataatcatatataaacacatacatacattgtattagtcttctagtgctgccataacaaagtactgcagactgggtggcttaaccagcagatatctattgtcttacaactctggaggcttgagatcaggatgtgggcaacgttggtttcttctgaggcttctctccttgtcttgtagatggctttctcccttgtcttcacatggtttctcctttatatatctttgtcctaatctcctcttctaataaagataccagtattgttgggctagggcccaccgtaatgaccttattttaactaactacctatttaaaaacactatctccaggtatagtcacatgctgaggtactggggtttaggactgcaaggtataaatttgggatgggggaacacaattcagcccattgcatacatacacatgtgtatatatttatatataccacaaatctgaatggtcaaaaatatggtaaaaaattccaattgcactatcctacagggaaatgcgaaatagaataacaataggatagcactttatacccatcaaactgccaaaattataattactagtgggcttgtggataaaagagtgttctcatgctatattagtggataagtagtatagtcttttcaaaaccaatatatgccttttgaaattctgattattaagatgtttaagatggagtgagccacatttccctgtgtgtcccactggatgcaactaaaaatcctgaacaggccgggcacagtggctcacgcctgtaatcccagcactttgggaggccgaggcaggcggatcacgaggtcaggagatcgagaccatcctggctaacatagtgaaaccccgtctctactaaaaatacaaaaaattagccgggcatggtggcggccgcctgtagtcccagctactcaggaggctgaggcaggagaatggcgtgaacccggaaggcggagactgcagtgagccaagatcgtgccactgcactccaggccggcgacagagtgagactccgtttcaaaaaaaaaaaaaaaaaatcctgaacgaaatgcatgggaaccttgaaaagttataatgtgagttatactcacctaccagaatgtggcatatgttacaattctatgcccctcctctcaaagctttagccctttaactttgggttgagcctcatatttagcttgaatttctagtaatagtgatatattattctccagagttaaagtcctttactatccattattctaaaaattttaaggttgtttagtcctttgagttgcatttttattttttacatagttcagggtattgctttccttctgaaggattcagatttcacatttgtgcaagagtctaatgcttagtatttaattctagtggcacagagctttttcttttctccctcttctctccagcctcatggctttggtttagaattccttcagcctgatagaatattgtattttataatttccttattgtgctatttactagatatttgttcttctatttttttctattcataatttctccctttcccaccacatctttttccaagtaggatgtgcacttgccacagtatctggacagttaaactgtctcattttcttggagacggtgatgaaaactagagagatatagtgacataagcagagccagaaaacaatttcactgaagatgatatatattttttttcctctgggatttctaatatagcttttggtggagataagagtctggaattgagaaagaagagattggaattgagaaaaagagtctgagaaagcacagggagagacacaaaggcagagaccaagagacacaggggaaggatcttcagaggaagagtccagggagaaagatgctaagacagagggataagaaaagaagaaaaaaaaggaccaggaggagagagacccaaaccataaatcactcctatttccattagcagtaaaattgataatctattttcatacaatgaaataccatgtgacaatgaagattcacaaaaataaagctatacacaacaatatgaataagtatcacaaagacaatttttagtaaaatggtaagtgtcaaaagaatatatacagtattatattatttacataaagttcaaaaatgggcaaaattaacttatatagtttagggatacagaggaagaaaagtataaaggttagtaaggacatgattataataaaagacaagatagtggctacctcttagaaagagttcatttgagaataaacacatgtgttttgtggggatagcagcaatattgtatttcatgacctagatgtttgttttataattttgtgttttaaaaaattgtaggatttatgatttatttcgtagatggatcctacaaatgatagggaaattgcagtaggaatgaagaggaaggaacatgtacaggatttgtttagaagatagaaggcacatgattttgtaaataattagctatgtttggtaaaggactaagaggattcaaagatgattaccaaatttctgatatgggtaactagaagaagagtgagacaaaatggaagaaagtgtatttaaagaaatgatagcaaaaactttccaaatctggagaaagatgtaaatatccacgtacaagaagctcaaagatctctagtcagattagattcaaacaagactatatgaagacacgttacaatcaaactgtcaaatatcaaagacaaagagagaatcctgaaagcaacaacaaaaaagaagcaaaccacatacaaggaaattccaataaggcagaaactttacaggtcagaagagggtgggatgatatattccgagtactgggaaaactttacctagaaaatgtttccttcagaaatgcagagagataaagactttgccacacaattccagttagacaagagaaataaattaaagacatctattgtacactatggtgactacagttaataaattacccattccaatatatacatatataaacattgtgatgtacatcataatatattctatttttccctgtcaattaaaaaataaatttaaaaagattggatagagaagaatcagccattctagtaattaagcctgaggaagcttacattccagtgatttcagataaccattatgcaagttaaggaataaactggataggatgatattaaaaaaacaaaaccaccaatgagatacaccagaatggctaaaattaaaaaggctgtccataccaagtattggtaaagatgtagagtaatgagaactctcataaatttctggtcaggaaatccaaacatcgaaagccaaacatcggcataccctattgactcaggaaatccactcctagtatacacctgttatgtcctgaatcatgtcccctagaattaatatgctgaagccctaacactagtatttcagaatgtgactgtatttggagatagggtctttaaggggtttattaagttaaaatgaggttgttacaatgggccctaatccaatatgactagtgtccttataagaagaggaaatgtgggccaggcacagtggctcacgcctgtaatcccagcattttgggaggccaaggcgggcggatcacgaggtcaagagatcgagaccatcctggccaacatggtgaaaccccatctctactgaaaatacaaaaattagctggacatggtggcgagctcctgtagtcccagctactcgggagactgaggcagaagattgcttgaacccaggaggtggaggttgcagtgagcagagatcacgccactgcactccagactggcagacagaccgagactccatttgaaaaaaaaaaagaagaggaaatgtgtacacacagagacaccagggatgcatattcacagaggaaagaccaagccaaggagaggtgtcagtaaaaaccaaacctgccaataccttgatcttggaattttagtgttcaaaactgtgagaaaacacattcctgttatttacacctcccagtctgtggtatattgttatggcaaccctagccactagtacagcacccaaaagtagtgtgtacatatttcacaaaagacatgtaactatttaatccatgtggagtgtcaaaaggcaaaaatacaacaaatgtattttaaagattgtaattggcttttatacatgattctagaatcagatagccctcagaaccaaatacagaacagcagccagcaacatagtatggatagaaattggaagtgaggtttagagacagcttaattgattacagttgggcatttttgccttatttgaagctgttagtcgcctgcaattgatggaagttcagctgctataatcggctgagactgagctgtttgttataaaagcatattcctaaattaggctttcagttagttcatcaactaagccaggctgcaactttgttgtgcaaggactcaagtgcaaaggtacccttaggcaaaattcagattaatttaaaaggactttacttttgttagttatgtgaaatgaagtggaatctattttttccaagtggatagtcatattttctattatcatttaccaactagctgatttttttcctgtactggttggagatgctgcctttattatatattaagtttcaacttattatatattaagtttccgcttacatcttgtcagtttctggactccatattttgtttgatatatttatctattctgcattaagactgcatttttaattataatagctttataatatctcaatgttgtataggaaaaaaacttcaattattaattagttatactaagccaatgtctaagtattgcttagtggtttgtgggcaaccatcttacacagtacctagtaacagagtagacaagtgtttattgaatggatggatgaatggatgtgtggaagaggctttcagaaacaattcccttcatagactaaggccaatgttacttttgcttagctctttagtttgaaataatttaaaatgtacagaaaagttacaagaataatacatggaacttgcacacaccctttacccagattcacaaatgtttaacattttgcaattttgtttttcattttcttttctttatatacacacttctgttacttattttctatttgaaaattagttgcagacatcacatccctttacctctcaatactttagtacacatttcctgtgaataaagatatcttttacataacagacacttcaaattgataaagcacatttccataatttacaactggtattccagttgtatcaaccaatgctgtcatttatagcattttcttctttgaagtacagggatctagtacaagtaactacttgtcctgcttctttcatttccttgaatctggaccttcatcagatggtaactttaagcacccaaaggtttttttctggtttctcctctgtgtagtttaagaccatgcaaacatcttgctactcatcaaaatgccccccatataacatccaaattaatctttatcatgatggtttatgactgtctcctcacattgggattggggcccaactgattattaacaatctacttttttggaagatataatatctcttcctgggaataagataatgggcataacatataataattcctaattgtatcatgacaatcacaatccaaaatactaaatctgtgatgtgtctaaatctcttttccccattgtttttgcaggcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggttagttattatatttttcttgtaccaacagctgtgaatgcttcactagccattcgtatgctcttttgcccactagctcacatgctgtcatttatagcattttcttccttgaggtacagggatctagtttctcctctgagtagttattattttcacccttgcaactaataaacagtttgaaggatcacgtagtagttctatttttagttttttgaggaacctccttactcttttccacagtatttgtacttatttacactcccaccaacagtgtacaagcattccccttttgccacatcctcaccagcattttttaattattttgtctttttgataaaagccatttaactggagtgaaatatctcattgtgcttttggtttgcatttctctggtaattagtgatgttgagcagtttttcatatacttgttggccatttgtatgtcttctttttttttttttttttttttttttcagacggagtctcgctctgtagcccaggctggagtgcggtggcacgatctcggctcactgcaagctccgccacccgggttcacgccattctcctgcctcagcctcccgagtagctgggactacaggtgcccgccaccacacccagctaattttttgtatttttagtagagacagggtttcaccgtgttagccaggatggtctcgatttcctgacctcgtgatccacccgcctcggcctcccaaagtgctgggattacaggcgtgagccaccgtgcccagcctgaatgtcttcttttgagaaatgtctattcagatctttgtccatttttaatagggttctttgttttttttgctattgactagagtttcttatatattctggttattaatgccctctcagttgtatagtttgcaaatatttcatcccatcctataaattgtctcttcactttgttaattgtttcctttgctgtccagaagctttatggcttgatataatcccatttgtctacttttgctttagtcccctgtgcttttgaggtcttacctgcaaaatctttcccagaccaatgtcctggcgcattcccccaatgttttcttccagtagtttcatactttcaggttgtatattttagtctctaatccattttgatttgatttttgtatatagtgagagataggggtatagtttcattcttctgcatgtggatatccagttttcccacaccatttattgaagagactattctttcaccagtgcgtgttcttggcactttgtcaaaggtgagttggctataaatgtgtggatttatttctgggttttctgtcgtgttccactggcatatatttctggttttatgccagtaccgtgctgtttttgttactacagctttgtagtatagtttcaagtcaagtagtgtcatgcctccagctttgttcattttgctccagattatttagctgtttggagtcttttgtggttccacacaaattttaagattcttttttctatttctgtgaaaaacttcactggcatttggataggtattacattaaatctggtagcattgatattttaacaatattagtttttccagcccattaaaatgggatagataccttttcagttttttgtgtgttcttcaattccctttatcagtattttagttttcattatagagatatctcagctctttggtttaatttattccaatatatttatttttattatagctattgtaaatgatttttaaaaaatttctttttaggttgttagctcttggtatatagaaatgctactgatttttgcatgttggttttgtatcctgcaactttactgaatttgtttatcagttctaatagttttttgatggagtctttagttttttgtgaaatataagattatgtcatctataaacaaggagaatttgacttcttcctttccaatttgggtaccctttatttctttctcttgcttacttgttctggcttggacttccaggactacattttatagaattggtgaaagtgggcatccttatcttgtttcagatcttaaaggaaaggcttttggttttccacatttggtatgatattagccgtagtttgtcatatatggcatttattgttttgaggtaagctttctatacccagtttgtttagagttttctcatgaagggatgttgaatttaatctttttggcatcaattgaaatgatcatttgtttttgtccttcattctgttgatatgatgtatcacattgattcatttccatatgttgaaccatccttgcatccctgggatgaatcccccttgatcatgatgaatgatcttttactgtgttgttgaatttggtttgctagtagttcgttgaggatttttgcatcaatgttcatcagagatattggcctgtagtttctttttgtgtatgtgtgtgtctttgtctggtttggtttcagggtaatactggccttgtggaatcagtttggaagtatttttcccccttgatttttgggatagtttgtgaagagctggtattagttctttttttttattattatacattaagttttagggtacatgtgcacaatgtgcaggttagttacatatgtatacatgtgccatgctggtgtgctgtacccattaactcgtcatttagcattaggtatatcgcctaatgctatccctctccccttcccccaccccacaacagtccccagagtgtgatgttccccttcctgtgtccatgtgttctcattgttcaattcccacctatgagtgagaatatgcagtgtttggttttttgttcttgcgatcgtttactgagaatgatgatttccaatttcatccatgtccctacaaaggacatgaactcatcatttttatggcggcatagtattccatggtgtatatgtgccacattttcttactccagtctatcattgttggacatttgggttggttccaagtctttgctattgtgaatactgccgctataaacatacgtgtgcatgtgtctctatagcagcatgatttatagtcctttgggtatatacccagtaatgggatggctgggtcaaatggtatttctagttctagatccctgaggaatcgccacactgacttccacaatggttgaactagtttacagtcccaccaacattgtaaaagtgttcctatttctccacatcctctccagcacctgttgtttcctgactttttaatgatcgccattctaactggtgtgagatggtatctcactgtggttttgatttgcatttctctgatggccagtgatggtgagcattttttcatgtgttttttggctgcataaatgtcttcttttgtgaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagttcccatttgtcaattttggcttttgttgccattgcttttggtgttttagacatgaagtccttgcacatgcctatgtcctgaatggtattgcctaggttttcttctagggtttttatggttttaggtctaacgtttaagtctttaatccatcttgaattaattttagtataaggtgtaaggaagggttccagtttcagctttctacatatggctagccagttttcccagcaccatttattaaatagggaatcctttccccactgcttatttttctcaggcttgtcaaagatcaggtagttgtagatgcgtggcgttatttctgagggctctgttctgttccattggtctatatctctgttttggtaccagtaccatgctgttttggttactgtagccttgtagcatagtttgaagtcagggagcgtgatgcctccagctttgttcattaggcttaggattgacttggcgatgcgggctcttttttggtttcatatgaactttaaagtagttttttccaattctgtgaagaaagtcattggtagcttgatggggatggcattgaatctataaattacattgggcagtatggccattttcatgatattgattcttcctacccatgagcatggaatagtcttccatttgtttgtatcctcttttatttccttgagcagtggtttgtagttctccttgaagaggtccttcacatccgttgtaagttgtattcctaggtattttattctctttgaagcaattgtgaatgggagttcgcttatgatttggctctctgtttgcctgttattggtgtataagaatgcttgtgatttttgtacattgattttgtatcctgaggctttgctgaagttgcttatcagcttaaggagattttgggctgagacaatggggttttctagatatacaatcctgacatctgcaaacagggacaatttgacttcctcttttcctaattgaatacactttatttccttctcctgcctaattgccctggccagaacttccaacactatgttgaataggaaaggtgagagaaggcatccctgtcttgtgccagttttcaaagggaatgcttccagtttttgcccattcagtatgatattggctgtgggtttgccatagatagctcttattattttgagatacgtcccatcaataccaaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttttgtctctgcccggctttggtatcaggatgatgctggcctcataaaatgagttcaggaggattccctctttttctattgattggaatagtttcagaaggaatggtaccaattcctccttctacctctggtagaatttggctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctcttttcttctttattagtcttgctagcggtctatcaattctgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccatctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttgttttacatttgctgaggagagctttacttccaactatgtggtcaattttggaataggtgtggtgtggtgctgaaaaaaatgtatattctgttgatttggggtggagagttctgtggatgtctattaggtccgcttggtgcagagctgagttcaattcctgagtatccttgttaactttctgtctcgttgatctgtctaatgttgacagtggggtgttaaagtctcccattattattgtgtgggagtctaagtctctttgtaggtcactcaggacttgctttatgaaactgggtgctcctgtattgggtgcatatatatttaggatagttagctcttcttgttgaattgatccctttaccattatgtaatggccttctttgtctcttttgatctttgttggtttaaagtctgttctatcagagactaggattgcaacccctgcctttttttgttttccacttgcttggtagatcttcctccatccttttattttgaggctatgtgtgtttctgcacgtgagatgggtttcctgaatacagcacactgatgggtcttgactctttatccaatttgccagtctgtgtcttttaattggagcatttagtccatttacatttaaagttaatattgttatgtgtgaatttgatcttgtcattttgatgttagctggttattttgctcgttagttgattcagtttcttcctagcattgatggtctttacaatttggcatgattttgcagtggctggtactggttgctcctttccatgtttagtgcttccttcagaagctctcttaggtcaggcctggtggtgacaaaatctctcagcatttgcttgtctgtaaaggattttatttctccttcacttatgaagcttagtttggctggatatgaaattctgggttgaaaattcttttctttaagaatgttgaatgttggcccccactctcttctggcttgtagagtttctgccgaaagatcagctgttagtctgatgggcttccctttgtgggtaacccgacctttctgtctggctgtccttaacattttttccttcatttcaactttggtgaatctgacaattatatgtcttggagttgctcttctcaaggagtatctttgtggcattctctgtatttcctgaatttgaatgttggcctgccttgctagatttggcaagttctcttggataataccctgcagagtgttttccaacttggttccattctccccatcactttcaggtacaccaatcagttgtagatttggtcttttcacatagtcccgtatttcttggaggcttcgtttgtttctttttattcttttttctctaaacttatcttcacacttcattttattcatttcatcttccattgctgataccctttcttccagttgatcgcattggttactgaggcttgtgcattcatcacatagttctcgtgccgtggttttcagctccatcaggtcctttaaccacttctctgcattggttattctagttgtccattcgtctaattttttttcaaagtttataacttctttgccattggttcgaacttcttcctttagctcggagtagtttgatcttctgaagccttcctctctcaactcatcaaagtcattctccatccagctttgttccattgctggtgaggagctgcattcctttggaggaggggaggtgctctgattcttagagtttttggtttttctgctctgttttttccccatctttgtggttttatctacctttggtctttgatgatggtgacgtacagatgggttttcggtgtggatgtcctttctgtttgttagttttccttctaacagtcaggaccctcagctgcaggtctgttggagtttgctggaggtccactccagaccctgtttgcctgggtatcagcagcagaggctgcagaacagcagatattggtgaactgcaaatgctgctgcctgatcattcctctggaagttttgtctcagaggagtagctggccatgtgaggtgtcagtctgcccctactggggggtgcctcccagttaggctactcaggattcagggacccacttgaggaggcagtctgcccgttctcagatctcaagctgcgtgctgggagaaccactactctcttcaaagctgtcagacagggacatttaagtctgcagaggttattgctgtcttttgtttgtctgtgccctgcccgcagaggtggagcctacagaggcaggcaggcctccttgagctgtggggggctccacccagttcgagcttcccggccgctttgtttacctactcaagcctgagcaatggcgggcacccatcccccagccttgctgccaccttgcagtttgatctcagactgctgtgctagcaatgagcaaggctccatgggcgtaggaccctctgagccaggtgcaggatataatctcctggtgtgccgtttgttaagcccgttggaagagcgcagtattagggtgggagtgacccgattttccaggtgccatctgtcacccctttctttgactaggaaagggaattccctgaccccttgtgcttcctgggtgaggcgatgcctcgccctgcttcggctcacgcacagtgcactgcacccactgtcctgcacccactgtccggcactccccagtaagatgaacccggtacctcagttggaaatgcagaaatcacccgtcttctgcatcacttatgctgggagctgtagactggagctgttcctattcggccatcttggctcccaatgcaaagaccttcaaacaacgtgacttcattttctcactcctaccttttgtgctcttgtcatttatttgaattctacatatattttaaaccccataagacattattattgttttatataatcaatatcatttatatatatatatatatttacacctttcatttctttcattcttttctgcatttcttgcttccatctatgatcattttctttttgtctgaagaaacttctttggaacttccttcagtgtgtgttggctagtaaaaagttctctgtcagtttttggtcagaatgggtctttattttgcctagatacaagtccttggttggatttacatattgtgaatgttttctcccagtctgtggtttgtcttttcactcctttaagggtgcattatggttaatagaagttcttacatttaattaattcttatttttcagttttttatggttaatgccttttgtattctgtttcagaaatttttgcctatcctaagaacatgatgccatccttctatattttctttctacatattttaaatattttcttctagaagtctgattgctgtgttgttcacaattaagtttatgattcatttttaattaattttgatggagtgatgcagataaaagttcatttttccatatggatatttaattgctctagcaccaattgttggaaaaaaataatttcctcactgaattgcactgttgtctttgccatgaatctgatgactgtatcactgtagctttgtttctgtactctatttcaggggtaggttatgatccacaagccaaatttgcagcttgtttttatatggcattgagctaagaatttttttacatttttaaagaattgtcacacaaaacaaaaaaaaagcaaaaaaacaaataaggatatgtatcatggaccatatgtgtctacaaacctaaaatatttactatgttgctttttacagaaaaagtttgccaacccctgatctcttatattccattgacttattggtctatctttgtaccagtaacatactatcttatagtaagttttaatatttgttagtataattcctccaactttgctctctttgatttttatataaattttagaatcatcttgtcaattttatcaataaaaatatcttctgaggttttgatagggattacattgattctgcagatcaatttgggggagcatacctcttgacaatattgagtattcctgtccatgagcatggtttagttatttatttacatcttttaaattttctcttggcaatgtttttgtaaaattttagtgtacaggtcttgcacatttttgtaaagtgtattctttggtatttaatgctattataatattttttatggtatcagtttttgtcaattgtgtttttctagaaatatgtccctttcatctaagttgtttaatttacttgaagtaagttatttgtaatgttcttttatcatccttataatgtctgtactgatgtctccgttttcatacctgatattgttatttatattttatctattttaagtttatcgcctgcacccactaactcgtcatctagcattaggtatatctcccaatgatatccctcgcccctccccctagtgcacatgtaccctaaaacttaaagtataataaaaaaaaaaagtttgtcgcctttgttataggttcatcaaatttactaatcctaccataggatcaaatttttgctttgttcatcaggtcatggaattaaaaaaatttttttgttttgtttattttctatgttgaatttttatttttattttgctttgcatttcatttatttctggtcttttgttattattccaatactttctctggattcagttttctttttcttcttgacttcttgagattaaaacttggttcattgattttcaacatttcttactttttaaaagttcatacaaagcataaatttccctttatatactgctttaaccccatatcacaaattttgatgagtcatatttttattatcattgagtttaaaatattttataaattttacgttatttcttgttttattcatagttattttacagtgttttacttaatttcccaatatatggcgattttctggctctctctctgttgctgatttatttgttttactgtgatcacataacatactctatattatttcaatcatttgaaatttgttgagacttgctatatgcccagtgaataatttaatttgattaatggcccactgcatttgaaacaaatatgtctttgctgttattgggtagagtgtcatatatttgcctattatgtcaagttgctttatcatgtttttaaaatccttataaacttcctgatattttatctgtttcttacagacatggaggaaactgtgacatctctgtgattgttgagtttgttattttgatttttgtatttgttagtaagaatgtttcaaaataaatgaggcaatataaaatcaggtgcttacaactttaaggttgtattcttattaaatcaattctttcatctttgtgaaatgtcctttttgtctgaagtagtacttgttgccttaaacgtctgcattgtctaaaatttatacacctgcactatcatatttattttgcttaatgtttgtgtggtatatatttcccattcttttcttttcaacctatctctatccttatatttacagtgtgtcttttttaacattttctgtagtgcaagtctgttggttaattaattttgtcagtttttgcttctctgaaaagtctttatttctgtttttgaattatatcttcactgtgtatagaattctgggtttgtggttgttgtttttgttttattacattttgttttattggtttttccctcagcactttaaaaatgccgctccattgtttctacttgcatagtttttcacaataagtttgttgtaattcccatttgcattcaactgtacataatgtatctttttaaaaaaatctggatggcttcaagctctttactttgatttttgtgtgtgtgtgtgtgtgtgtgtgtgtgtgtgtgtgtgtgtgttactttggcattctctaggcttattcaatctgtaatttggtatcattaattttgaaaaatatttatcatctgtgtcttcaaatattgcttctaattctttctcttcttctggtattgcatttacatatattatactgttcaattttgtcacacagctcttgaatatgctgttctagtttgttttctaactatttttccttctagttgttcagttttgttgacatttattgacctatttttacttcagtaattgtttcctgggttgttgagttaattgatgaactcatagatgacatacaatttatctttttattcttgtgtcacttgtgcttttgatgtcacatctaggaaggctttgtctagcccaaggccacatttacttccatattttcttctaagagtttgatagttgtagctgttacatatatgtctatgatctagtttgaataaatttttgtgtatggtgtgaagaagaggtctaacctcttttttattttttgcatgtaaacatccagttgtcccggcaccatttgttgaaaatatgattcttttcccattaagtcatcttgacacccttgttgaaaatcaattgaccataaatgtgagagtttatttctgaactctccattctgttccattgacccatacgtcttctataaattcttatagctaattctacattagactttggtttttcagatgtggtcatctcattagattatggtgatatgtttggttacaagttttatcttctccttggcaacattttttttattactgctcttcttttattcgtttttgttgttcctttctctttttgtgagacagggtctcactctgttgcccagggtggagtaagtggtgtgatcatggctcactgcagcctcaacctcctgggctcaagcaatcctcccacctcagcctcccaagtagtgggactacaggcatgcaccatcatgccaggctaacttttttattttttgtagagacagggtcttgctttgttgcccaggctggtcttgaactccaagctcaagcaatcctccaacctcagcttcccaaagtgctgggattaccagtatgagccactgcacctggccttgttgttcctttcttccttttatcttgtagtatcttgatcctttttgcttattatttatcattgaggtgagtttgttctaaataaacttttcgcagaaagtttatgtagatatattaatatcaatgaggcattaggagtgagttttagattagcaggaattctcttatgaaaggtattgattgtatgtgtgagttttcagcctttacttctctccagcccatcaagatcaaagctgcagagttgtttacatttcagaatttctttcctcccctccccaccttgcaaaacagacttacagtgcaaaaatgacttgtcaatgtgattctttcttctggtcccatctttcctaccttttgagacttgtgttgaaaggagtccagtaaaaccaccgatgctagcttgtataccctgatcccattgttataatgaatgactgactgtttttcatatcaaagtataatacttgcaccttgatagaagaaagaaacaaggccaggcacagtggttcatgcctgtaatcccagcactttgggaggctgaagtaggaggaataattagactttgatattaaaaatggggaagatatggcggtataagatatgaggaagtatgtcttcttggacttttctgaaatctgccagccatgagcatccactctttttatcttttgatacctgttttatattaactatacttctattttgtggtttcatggcttcagatatcttccagcttaattgtactctgtctttaattatttgcagcaatttctgaaaggagcaagaagaaaggccagccctttcttcactaccttaaaaactggtcatcttttgaaaccccatgaaaggcacagtgggtgaccatctacatcaggagtgggcaaactatggcccttgggtagtctggtctctgtccgtttttgtaaggttttattggaacccatacacacacaaactgatcatctcttgttatgtgttaagttttcttataattattcttttctatttcatccagctgaattaccatttcaccttgtgtatgccctttccagtcttaaattatagaagctatgtctttgtggttttaaattatggaagctgtgccttcttgtgttttagtatggcaagatatttgttcttacttttcctctagaatctgcagtggattactttcagaagtaggtattgcctctaagtttcctgacttctgtttccttctccctgttctgtagtatatttatagattgcatgttttctcgtccttaaacaaggtacaaatatgttctgatcaaggtttgctagccgagaggataagtggcttgctcttagcctaactctctgtctacttaatggatgtcgaattcccttctcaactcaacagctagtaactagttccaagatcggataatagcttacagaattaattagttcagtgaaagccctggtttgatcacagaggcaggagactgatctatatatttgtagtgctgactagaccccaacttggccagatagcttatacctatgtcagaagttggaggaggagattgacagctgaggtgtctccaagggaattacaattattttcattttctttgtgtctgtaattatgtctcttttcttacttcaaattttgtatatgtgaaatttcttaatttttatttggttatttattttattgactttttcatcaaacaaccaactctaagttcttggattgaaatttatgaattaattataatgttttaaatttaccattagtcacacatacaatacaaaaagatattttcattacaaaattttaacccaagccattaaaactaaactccagcttggtcaccattcctaataccaggcccctctcagaggggagggtaaataaaagtccattttggtaactagtttgacgagaatctctaattgtttccctgtttttcttataatgtctgcctttgaattatcctctttttttcaagagttccatcatataatgtattcctttttgcttacagattgacctcctagaggcatgcatccccctgctccagtctgagctggttctctctaggcctgaggctcagttatcaacttgggacttttatttaccctccctcaggataggtacctggttcttggataccaggtcttactcttgtttgagatactcctttattttggtggcaaacattccataatcacttcctgataatggtgacatttgaggtagattttctgagtctttatatgttagaatatgtttttattctcctttgccacttgattgataatttggctgcacatagaatgtaagcattcacagggcttttgggagcagcttcccttgagaagaaggtggatgcagttaagatcttccctgaaaagactgtgtgaaatgacaaggctattgaggtacccaacgggtagcttggtaaaggtgtatcttgtctcttatgtttatgcatctactttaccaccatgtaattagcctattataacttgttgcattccttcactcagctaatcttgttcatggtagaaattaatattgctagtaccatggtagaattttatattagctggatcctagacctaaatgctccttccttgtgcttacatattctgcaagtgggtgacagtggatgctaggtattgtgttatgtgatttcaatgtattatatgatggggtagatactattagcctcatttgaaaattagaaacctattgttcagaaagtttaagtgactttctcaaagtcacacagctggtaaatggtagaactgggatttgaatccaggcaatctgatggatttaagaggaacctgtgccactatgtgatatagcaataacatctagccaatataaatactttcctgaattaaatcactgtcatattcagagagttctgtgtcactattaagaccctccattattgtgtatattaattacatttccctattttaatcccaatatctattcatttttatcacagtcctttcttatggtcacaaacaggcatagtacaacagcagcaatgcaaaaaccacttttatattacatgttccagggatttaacccaatgacctgtgatataatgatactgactagtattttttcatttatctgggaatgggagagaacctctaacagaacgttttagaatctgtgttatgagtaaccagagtcttattcttcctcatctccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgagggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacaggtatgaatgcattggttattcctttgctctgctcttgtgacatttgactttaccagatgatgacaccaacaatgagagttagaggatgaaaaatcaaggtgtcttgaaactcttactctggtgagatagagagaagagaggtttacaagagggtagaggaatcagggacaagaaggagcaatggggagcaggaagaaagtcaacctcacctatcaaccttatgagctgcaggggaaatcttagtctcatcagagaactttaagcaaggcagaaggaagaagcaagttcgtgttaaagaggttaaggacttggggaggattggttttcatgatactggggatccagagggcaaagtaggatgattttatttttaggtgagtagagggaggttgagcagtcaagtagtacagagaaatgtggaatataaacataaggagagtcagtcagtcacaaatatttatggaacacctactacatgccagacacttttgtacacattggagtgcagcacagcaggagcttatattctattggaaagagcaagagacaagttagtacaaaactaaataaggcaatctcaattgtgttgttcagaagatagaatagaataatatggtagagagaataatatgatagagtaatacggtagagtgttacattagctgtggtggtcatagaaatcatctttgaggagttgagacctaaatgatgataacaggccagctgatggagctctgagagaagatgtttccagacagagggaagagaaaatgcaaaggccctgagaatggaaaaagtttaccatgtttgaggaacaagaagggacaagcatgacttgtcactttcccaccttgctttctagctcaagtaagcccttattgctgcattgcaaccatagactatttccctagtccactgactttctcattctcctggacctctatcttagattttctgtgttttccttaaatctcgagcaccttttttccattctccaatgcccattttcactcttagctgatgctgtgcaatgaacctccacagactcccaacatcacatttactggcatttgtacccatatactctgcctgcacacttattacaataaatagagtgtctgtgctcctaaggccaacctctccagttttgtacttgattcccatctcttctcccttcataaaaaatgttgctccagcaatttctccttttctcccttacatcatcaatttatctctccactagattaatctcatcaacatcaatcatgctattatttcctcccctatctttacagaaaccgtcttaaaataattgtccctgcttgcagcctttgcatcttttcctgccattctctcctctttaacccactccaaagaagcttttatctctattatttcataagaactacattttcaaggtcattattgatctttacattactgattactagccctcatcttatttgaattctcagtagtatttgagaggtgattactccatcgttgatacaggttctcacttggtttctctaacaccacttttcttcacttttctactaaacttactgccaatctttgtcaactttgcgagtccttcttcatccccctaatctttaaaggttagagtgctccagggattagttctccaacttcttctttattctatttatactcactctgtgacgacattgtttagcctcatgattttaagtactatctatctgcagataattccagttgaatatctggagatattctcagatctctctcctgaagtcaaaatttacatatcaactccctaccttaacatgcacacaattagactcttaattcctgccccttcccaaaacctgctgattgctcagccttctccatggcaatcaaaaaccattcctggccgggcatggtggctcactcctgtaaccccagcacttggggaagctgaggcaggtggattggttgagccccagagttcaagatcagcctgggcaacatggcaaaacctcatctctattaaaaatacaaaaattagccaggcgtggtggtgcacacctgcagtcccagctactcaggaggctgaggcacgagaatcgcttgaactggggagacggaggttgcagtgagctgagatggcctcactgcactccagcctgggcaacagagtcagacttgatctcaaaaaaataaataagtaaaaccattccctatttcagttattcagtcacagatcttgaagttttccaactctttttttcttacattaacatctaatctgtaaaggatcctgtattagtccattttcacactgctaataaagacatacctgagactgggcaatttacaaaagaaagaagtttaatggactcacagttccacatggctggggaggcctcacaatcatggcagaaggcagggaggagcaagttatatctcacatggatggcacaggcaaagagagagagcttgtgcagggaaactcctctttttaaaaccatcagatcttgtgagacttattcactatcatgagaacagcaagggaaggacctactgccatgattcagttacctcctatcaggtccctcccacagaacatgggaattcaagatgagatttgggtagggacacagccaaaccatatcattccaccccatcccctcccaaatctcgtgtcctcacatttcaaaaccaatcatgccttcccaacagtcccccaaagtcataacacatttcagcattaactcaaaagtccacagtccaatgtctcatctaagacaaggcaagtcccttccacctatgagcatgtaaagtcaaaagcaagttagttacttcctagatacaatggggtataggcattgggtaaatacagccattccaaatgggagaaattggccaaaacaaagggcctacaggccccatgcaagtctgaaattctacggggcagtcaaatcttaaatctctaaagtgatctcctttgactccatgtcttgcatctgagtcatgctgatgcaagaggtgggtgcccatggtcttgggcagctccacccctgtggctttgcagggtacagcctcccttgtgtctgccttcatgggctggcattttctgtagcttttccagatgctggtgcaagtttctgatggatctaccattccggggtctggaggacggtggccctcttctcacagctccactaggtggtaccccagtagggactctgtgtgggtgccctgagcccacatttcccttctgcactgccctagcagagtttctacatgaaggcccacccccgcagcaaacttctgcctgggcatccaggcacttccattaatttctaaacaacaaagcattcaagaggcgacttgggtgctattaagggcattcagtttcataagggaagcagagcataaaagtttggaaaatttgcagcctgataatgttagagaaaagcaaatcccattttctgaggagaaattcaagcaggctgcagaaatttgcataagtaatgaggagccgaatgttaatccccaagacaatggggaaaatgtctccagggcatgtcagaggtcttcacaccagcccctcccatcaccggcccagaggcctaagaggaaaaagttgtttcatgggctgggcccaggatccccatgctgtgtgcagcctagggagtcggtgccttgtgtcccagccgctacagccatggctgaaaggggtcaatgtagagctcaggctgtggcttcatagggtacaagtcccaagccttggcagcttccacatgatgttgagcctgcgagtgcacagaagtcaagaactggggtttgggaacttccgcctagatttcagaagatgtatgaaaacacctggatgcctaggcagaagtttgctgcgggggtgggccctcatggagaacctctgctagggcagtgcagaagggaaatgtgggctcagagcacacacacagagtccctgctggggtaccacctagtggagctgtgagaagaggaccaccgtcctccaggccccagaatggtagataccctaaatcatctctttcaaattcgaagttccacaaatctctaggacaggagcaaaatgccaccagtatctttgctaaaacataacaagagttacctttgctccagttcccaacaagttcctcatctctatctgagaccacctcagcctggatttcattgtccatatcattatcagccttttggtcaaagccattcaacaagtctctagagagttccaaactttccacattttcctgtcgtcttctgagccctccaaactgttccaacctctgcctgttacccagttccaaagtcgcttccacatttttgggtatcttttcagcagcaccccactctactggtaccaacttactgtattagtctgttctcacactgctgataaagatatacctgagactgggaaatttacaaaggaaagaggttttatggacttactgttccacatggctggggaggcctcaaaatcatggcagaaggcaaggaggagcaagtcttgtcttacatggatggcagcaggcaaagaaagaaagcttgtgcaggaaaactcttttttttcttttcttctttttagacagagtcttgctctgtcacgcaggctggagtcagtggcgtgatcttggctcactgcaacctccacctcccgggttcaagtgattctcctgcctcagccttccaagtagctggtactacaggcatgtgccaccacatgagatgagattttggtagggacacagccaaaccatatcattccccctgtcccctcccaaatctcatgtcctcacatttcaaaaccaatcatgccttcccaacagtcccccaaagtcataactcatttcagcattaactcaaaagtccacagtatttttagtagagatggggtttcaccatattggccagactggtctctaactcctgaccttatgatccgcccgccttggcctcccaaagcactgggattacaggtgtgagccaccatgcccagccaaaaactcttctttttaaaaccatcagttctcatgagacttattcactatcacaagaacagcataggaaagatctgcccccatgattcaattacctcccaccaggtccctcccacaacacatgggaattcacgatgagatttgggtggggatcctcttggctatcatttcaaaaaatagtcagggttgattatggacttagtattgaataagatgaaaatgtactgaaatggaacgatgaagataattgaccagggaaagcaggttacaagccaagagaggatacagtgtcacttcagatgctataaaagtgatgtttttattttttgaatgttatttggctatattttcaaattatctgcactgcatatgcactgcttctgtaataataaaagggtattaaaataataaaatcaagtctataaatcacacacacacaccccagcctcttctctacacctcagtgactaccaaccacatctaaattatcatcatttctcatctgaattattgcaagaagccattgcaataattcagatgagagttgatacaaagccttcctgtttccaaccttaccctcatatagtcttttcccaacattgcatctaaagtaatttttcaaattgcaattctgatcactgttctctgcttcagatcctccagtggattttcatctcactcagtaaattccaaagccttcaccatggccttcaagaccctacgaaatttgaccctctgcaacctctctgccttcatctgttaccattgtctcctgttaatcctgcctcagccacactgacctccttgttcttctcaaatggactagatgtgtgcctatctctagaccattacagtttctgttctctctacttaaaattatgtccctgatactctaatgcaagttctcttacttccttcaggacgctgctcaaatttcattttatcagtgaggctttccctgaacactgtatgtaaatattgctcccaccattttttttcaatgcacttaacagtgcctgaaatattatatatttatttctttattgtctatcttctctgactataagttaagctcattaagaacacaaactttggaggtattgttcaatgttgtgtccccagaactttgaacagtgcctggcacgtggcagatgttcaaataaatgtatgttgaatgaattagaaaatgataaatgtagggagacaaaagcaggtctcccatttatatccaaactctaggactctaggaaagactgattatatggaatcgtgtcacacagcatccatgggcaagagtggaggcagagataccagttaagatgctattgcagtcatacagataaaagaagacagttatttagaccagtgtggtggtgacagaaatggaaagaaatggaaggatgttgggtataattaaagataagcatataagactggctgttaattgagtatgggaagaatgaggagagaggatgtaaagaacatttctttttgtttgtttgttttgttttgtttttgtttctttttattatactttaagttctagggtacgtgtgcacaacctgcaggtttgttacatatgtatacatgtgccatgttggtgtgctgcgcccattaactcatcatttacattaggtatatctcctaatgctatccctccctcttccccccaccccccaacaggccccggtgtgtgatgttcccctacctgtgtccaagtgttctcattgttcaattcccacctatgagtgagaacatacagtgtttggttttttgtccttgcgatagtttgctgagaatgatggtttccagcttcatccatgtccctacaaaggacatgaactcatccttttttagggctgcatagtattccatggtgtatatgtgccacattttcttaatccagtctatcattgatggacatttgggttggttccaagtctttgctattgtgaatagtgccgcaataaatatacgtgtgcatgtgtctttatagcagcatgatttatagtcctttgggtatatacccagtaatgggatggctgggtcaaatggcatttctagttctagatccctgaggaattgccacactgacttccacaatggttgaactagtttacagtcccaccaacagtgtaaaagtgttcctatttctccacatcctctccagcacgtgttgtttcctgactttttaatgatcgccattctaactggtgtgagatggtatctcactgtggttttgatttgcatttctctgatggccagtgatgatgagcatattttcatgtgtcttttggctgcataaatgtcttcttttgagaagtgtctgttcatatcctttgtataagattattagtggatttctcagaagaaatattgtagaccagaagggagtgaaaatatagatttaaaatcctgaaaggaaataaaaactagcaatgaaaaatactatatccagtaattttatctttcagaaatgaaggggtgataaagattttctcagaaagacaaaagctagatctgctttataagaaatgctagtaggagttcttcaagctgaagaaagaggatgcttattagtaatatgaaaacatatgaaaggataaaactcactagtaaaaataagtacattgtcaaatccaaaacactctagtagtgtaatggcagtgggtaaattaattatatctttagtataaaagataaaagacaaagaaagctattttaaaaactaaagctataataatgtgttaaggaatgcaaattattaaaatatgtaaactgtcacatcaaaaacataaaataggctgggcacagtggctcatggctgtaatcccaacactttgtgggggccaaggtgggaggatcacttgagcccaggcatttgagactaacttgggcaggatagtgagatctcatctctataaaaaatttaaaaattagtaaagcatggtggtgcatgcctgtagtcccagctactcaggaggtggaggtgggaggactgcttgagcctgggggggtcaaggctacagtaagcaatgatcacaccactacactccagcctgggcaacagagcaagaccctgtctcaaaaaaaataataatatgtaggaggaagggaataaaagtgtagagtttgtggatgcaataaaaattaagttgttatcagtttaaaatagcctgctaattttgtgtaagcctcatagtaaccacagagcaaaagcctatagtagatacacaaaacattttaaaaaggtccaaagcataccactacagaaagccatcaaactataaaggaagaatgcaacagaagaagaaaggatcaaaggatctaaaaaaaaaaaaagaaagaaagcaattaacaaaatgacacaagtatgaccaaagtccactgcttctttattactgatatagaatatctttcagatcttaagggactgattaattacttgggagagaaagtttgtgttgagaagatttgcttgtgttgcaatgagaaggggaagttctactcaacagaagctgtacaggcacatatgacaaaagctggtgtaagctttttacagatggtgatgctgctttggaatttgcagacttgtatgagtttaggagtagctacccagatcacaaggaaggggaggaccctaatgaggctgaggagtcgcccttaggaaaggacttagaatatgatgatgaaagcatggaactgattctgccttctgatgccagagtgggtcatcactccttgatgagatactacaaacagtgatttggcttgtcaagagctgtggtagttgctaaatattgtgaggccatgggccgagtgcttcagtaatagagagccctgggatagactggcaacacaggagcagctgttacatgaaagtgagacatgcattatatccaaaggatgaagtcaaaatggatgctgaagacagaaatgaagaacaatgccaccaagcagatgcactttagggtccaagtgagattctgagagtctgccaggattgagtgattgtctgctgcccaagtttcctccttgccctgaggaccagggaaagccagattgtatgatggacacttttgctgctacttcacttgctctaacataataataaaaatgaaaatctaaaaaatattttattgaagaatgaaggtgaaagaaatacattttcagacaagcataaacagagaaacttcaccattagcaaaagtccactaaaatattctaatgttatacttgagacaataaaaaagtgatacagaatggaaggcatgagagacaagatgggataaagagcaaacaaagttaaatatgtggataaatagagataagtatcataaaacatggtcaaatgttttatgagcgttaagatatatagaattgctttattcacagttggtttgctgtcataacacaagtatcatgaaaatcactgctaaatctaagccaaaattgggaaaggaaaaggttcatgtcactatcatcaacgttggacatgtagactcaggaaagttcaacactactggtcatctgatctataaatgtgatgtgatcaacaaaggaaccattgaaaaatttgagaaagaacctgctgagatgggaaagggctcatttgagtatgcttgggtcttggataactataaactgaacatgaatggaatatcaccattgatatctcctaaagaaacctgaggccaaaaatatcctgtgaccatcattgatgccccagcacacaggggctttattaaaaaaaaaaaaaaaaaaaaaaacatgattagagtgatatcaccaaaatggtggatagaagcaatctggcttcactctcctccagaaaaaccaaaaacaactattcagtgtctagcttatcaccaggaatatcccataactcaaaacagaggctgtgaggatctgagtggccacatagaagagaaaaactgcaagcagaagataacaaaaatgggcctgtttaactgcagcatccccttcccaagctgccaggcaccatgcagaaaagttcccccagactgacagtatgtacatcagaaaaagtgacatctagatgaagagccagctttcccaccatcttgggttcctttgcagaaaaatcattcctgcctcaatccgtgggaagcagcctgattgcctctagggtaaaaaaatcctgagggcagctagagacaaaggatggaggcggggctagcaaccccagcatgcaaaacacattggctgctcttcatctaagccaaagaagacaccaaatgagagagaatgttcagcccgtggttcctctggacacaaaatcctaaccagatgtctcacccaaccaggatatccagtttgggacctcccccaaatcgggaataggcagtaatccaagccgttgcaagagctgcagcaaatctgggcttacagcaccatctagtgccaaaaaagaggcagtaatctcagagtaaggaagctctaattcatacataacctttagacaggcatactcctgaaaaaccaaactaagccagacacaaagactggaataaataacttagcattcatacaaagacatagatatatgtgcataaaaaacaagagcaaatagggagctatgacctctccaaatggaaacagcatggagccagtgaccaaccctaatgagatggcaaattgtagctctcaaatcaataattcaaaataaaagttctgaggaaactcaaagaacacaaaaaagcaactgagaaatttatgagataaatttaacagagaaatcaaaataataatttaaaaaaccagaaatgctggagctgagaaatacaactgaacggaaaaaaaaaatgcactggaaagtctaaacagcggaactgatcaagcaaaacgaacaatcaatgagctcaaagacaggctatttgaaaatacacagtcaaaggacaaaaaataattaaaaggaatgaagaacacttgcaagatctagaggactgcctcagtagaacaaatctaagagtcatgggccttcaagagagaaagagcaatgaataaaaagctcaaagaaataacagaaaatatttccaaacctacagagagatgtaagtatccagttataggaaggctgaagatcaccaaacagattcaacccaaataagactaccccaaggcatacaataattaaactctcaaaggtcaaagacaaagaggggatcctaaaaagagcaagaaaaaagaagcaaataacatataaaggagctccagttcatccgggaatatactctggaccagatgaacctacctgacattttacagaacattttatccaactactacagaatatacattcttcttatcagcacatggaacattctccaggatagactatatattaggccagaaaacaagtctcaacatttaaaaaaataaaattatattaagtatcttttctgactacagtagaataaaactagaaatcaatgacaagaggaacgtttgaaactatacaaatacatggaaattaaacaacatgctcctgaacaaccaataagtcaatgaagaaattaagaaggaaatttattgaaacaaatgaaaatggaaacaacataccaaaatgaatgggatacaacaaaagcggtactaagagagaagtttatagctataaatgcctacatcaaaaaagaaagactcaaataaacctggtaatgatgtaactcaaggacatagaaaaacaagagcaaaccaaacccaaaattagtagaaggaaaataataataataatcatagaaataaataatattgagaaaaagaaaacaatatgaaagaccaatgaaatttttaaaatggctttttgaaagataaaatttaaaatctttagctagactaaggaaaaaaaatgagagaagacccaaataattgaaatcaaagatgaaaagagtcattaaaactgataacacaaaaatacaaagtttcactagaaactattatgatcaactatatgccaacaaactggaaaaactagaagaaatggataaatttctggacacatacaacttaccaagattgaactatgaggaaatagaaaacttgagcagaccaataactagtaatgagattgaagcagtagtaaaaagtctggcattaaataaaagtccaggacctgatgacttcactgctgaagaaaaacttacaccaattatactgaaactatttaatattgcaaaaaattgaagagaaaagaatgtttccaaactcattctacaagaccagcattatcccaatacccaaaccagacaaagacacaacaacagcaaaaagaaaactacaggccaacttcgctgatgaatatagatgcaaaaatcctcaacaaagtactagcaaactaaattcaacaacacattaaaatgagtatttgtcatgcccaagggggattcatcctaggaacacaaagatagttcaacatatggaaatcaataaatgtgatacaccacattaacagaaggaaagacaaaaaccatatatttatttcaataaatgtcaagaaagcattgaataaaattcaacatcccttcatgataaaaactctcaacaaatttggtttaaaggagcatacctcaaaacagtaaatgttatatatgacaagcccacagctaacattacaccaaatgggaaaaaattgaaagcctttcctctaagatctggaacaagacaagcatgcccactttcatcaattctattaaatgcagtcctggaagtccaagatggagcaattaagcaaagggccttcaaattagaaaaaaagaaatcaaattccccttgtttgtagacgatataatgttatatttagaaaaacctaaacactccaccaaaaaactgttagaactgatcaacaaattcagtagagttgcaagaagcaaaaccaacatacaaaaatcagtagcatttctatataccaagagctaacaatccgagagagaaatcataaaagcattttcattttcaatagctataataaaaataaatatctaggaacaaatttaaccaaagaggtgaaagatctctatactgacaactgtaaaaccctgatgaaaggaattgaagaagacacacaaaaaatgaaaaggtatctatcccatgttcatagaatggaagaattcatattgttaaaatatcaatactactagatttcatgtattacctatcaaaataccaataacatttttcacagaaatagaaaaagcagtcttaaaatttgtacagaaccacaaaagacccagatatggtttggctgtgtccccacccaaatctcatcttgaattgtagttcccataatccccacatgtcgtgggagggacccagtgggaagtgattgggtcatgggggcagttttcccccatgctgttctcgtgatagtgagtgagttctcatgaaatctgatggttttctaagtgtttggcatttcccctgctggcacttattcccactgccaccttgtgaagaagatgccttgcttcccctacgccttccaccatgattgcaagtttcctgagacctccccagcaatgcggaactgtgagtcaattatacctctttcctttatagattacccagtctccagcagttctttatagcagtatgagaacagactaatacagtaaattggtaccgaggtagggggggcactgctataaggatacctgaaaatgtggaagcaactttggaactgtgtaacaggcagaggatggaacagtttggagggctcagaagaagacaggaaaatgtggcaatgtttggaacttcctagagacctggagggctcagaagaagacaggaaaatctgggaaagtttggaacttcctagagaatcattgaatagctttcaccaaaatgctgatagtgatatggacaatgaagttcagactgaggtggtatcagatggagatgacgaacttgttaggaataggaataaaggtggctcttgctatgctttagcaaagagattggcagcattttgcccctgccctagagatctgtggaactttgaacttgagagagatgatttggggtatctggcagaagaaatttctaagcaacaaagcattccagagtgacagagcataaaagtttgaaaagtttgcagcctgatgatgcagtagaaaagacaaacccattttctggggagaaattcaacccagctacagaaatttatataattaacaaggagccaaatgttaatcaccaagataatggggaaaatgtgtccagggcatgttagagaccttcgcagcagcccctcccatcacaggcctggaggcctaggagggaaaaatgctttcgtggcctgggtccagggctcccctgcagtgttcagcctgggacttggtgccctgtgtcccagccactccagctataagaggccaaagtacagcttgggctatagcttcagagggtgcaagcccccagcctttgttctgtgggtgcacagaagacaaaaattgaggtttgggaatgtccacctagatttcagaggatgtatggaaatgcctggatgtccaggcggaggtgtgctgcagaggcagagccctcgtggagaacctctgctagggcagtgaggaaaagaaatgtggggtgggagcccccacacagtcaccactggggcactgcctagtggagctgtgagaagagggccactgtcctccagaccccagaatggtagatccactgagagcttgcaccgtgggcctggaaaagccacaggcactcaatgccagcccatgaaagcagccaggagcagggctgtaccctgcaaagctatgggggtggagcttcccaaggctgtgggagcctgccttttgtatcagggtgacctaaatgtgagacacggagtcaaaggagaacattttggaactttcaggtttaatgactgccctattggatttcagacttgcatggggcctgtagcccctttgttttggccaatttctcccatttggaatgagtgtatttacccaatgcctgtacccctattgtatctaggaaggaactaacttgcttttgattttacaggctcataaacagaagggattttccttgtctcagatgagactttggacttggacttttgggttaaggctggaatgagctaacactttgggggactgttggaaaggcatgattctgtttttaaatgtgaggacatgagatttgggaggggccatgggtggaaacatatggtttggctctgtgtccccacccaaatctcatcttgaattgtagtatattgtttgtaaaaattcctgcctatccagagattttttaaaaaaaaacaatactttcttcaattttctcttacaatttaattttttacatttaactttttaatacttcctgtagactaaaagttattttggtgcattgtgtgaaccaaagatcaaagtagttttatttttttctgaaaacatctattcattttttcaattaattgattgtttatattaaggatctaggaggatctaaaattatggaattgtgggcaagggcaatttttgccttacatttcatgtaaggcaaaataatccccatgtgtcatgggagggacccagtaggaagtgattggatcatgggggcaggttcccccatgctgttctcatgacagtgagtaagttttcatgagatctgatggttttataagcatctggcatttccccttctgtcacctctccctcctgccaccttgtgaaaaaggtgccttgcttccccttcaccttccaccatgattgtaagtttcctgaggcctctccagccatgtggaactgtaagtcaattaaacctctttcctttataaattatgcagtctcaggcagttctttataccagcaggaaaacagactaatacagaccctaaatatccaaagcagtcctgagcaaagagaacaaagctggaggcatgatgctactttatttcaaactatactacaaagctgtagtaaccaaaacagcatggtactggcataaagacagaaacatatgccagtggaacacaacagagaacccagaaatgaatccacacatttagagccaactcatttttgacaaagtgccaagaatatgcattggtgaaagaatagtctcttcaataaatgatgttgggaaaactggatatccacatgcagaagaattaaactaaacccctatctctcactgtatacaaaaattaaatcaaaatggattagagacttaaatatacaacctgaaagtatgaagctactggaagaaaacattggggaaatgctccaggacattggtctgggaaatattttatggcctgggaaatatcaaaagcacagacaactaaagcaaaagtagacaaacgggattatatcaagctataaagcttccgcacaacaaaggaatcaattaacaaagtgaagggacaacctacaggatgggatgaaatatttgcaaactatacaactgagagggtattaataaccagaatatataaggaactcaaacaagtcaatggcaaaaaagcaaaggatcctattaaaaatgaacaaagatctgaataaacatttctcaaaagaaaacatacaaatggccaacaggtatatgaaaaactgctcaacatcactaattaccagataaatgcaaaccaaaagcacaatggatatttcactccagttaaatgacttttatcaaaaagacaaaaaataatgaatgctgatgaggatgtggcaaaaggggaatgcttgtacactattggtgggagtgtgaattagtacagatactatggaaaagagtatgtatgttcctcaagaaactaaaaatagaacgaccatgtgatccagcaatcccactgctggatatatatccaaagacaggaaatcagtgtatcaaagagatagttgcacaccaacatttattacagcaccattcacaatagctaggatataaaatcaacctaagtatacatcaacagatgaatggataaagactgtgtggtatatatacacaatagactattactcagccattaaaaagaatgaaatcctgtcatttgtggcaacatcgatgagcctggatgtcactgtgttaagtgaaataagccaggcatagaaagacaaatatcacgttttcacttacatgtgagagcttaaaaagtggatctcacggagatagagagtagaatggtgcttaaaggagtttgggaatggtatgggggggtgggatggaatgaagagaggttgattaataggtgtaaaatgaaggggtggcctgcccctcgtcacccacagtgacgagaaacactgtgggtgtttctcgtcaggtgggacgagagactgagaaaagaaataagacacagagacaaagcacaggaaagaaaagtgggcccaggggaccggcgctcagcatacggaggacccgcgccggcactggtctctcagttccctcagtatttattgatcattatctctaccatctcggagagggggatgtggcagaacaatagggtaatagtggagagagggtcagcaggaaaacatgtgaacaaaggtctctgtgtcataaataagtttaaggaaatgtgctgtgccctgatgtgcacgtatacaaacatcttggtgcattaaagagcagtattgccactagcctgtctcacctccagccttaaggcggttttctcttttctcagtaaatagaacatacaatcgggttttacaccgagacactccattgcccagggacgagcaggagacagatgccttcctcttatctcaactgcaaagaggacttcctctttcactaatcctcctcagcacagaccctttacgggtgtcgggctgggggacggtcaggtctttcccttcccacgaggccatatctcaggctatcacatggggagaaaccttggacaatacctggctttccagggcagaggtccctgcggccttccgcagtgtattgtgtccctgggtacttgagattagagaatggtgatgactttttttattattattattatactttaagttctagggtacatgtgcacaacgtgcaggtttgttacacgtgtatacatgcaccatgttggtgtgctgcacccactaactcgtcatttacattaggtatatctcccaatgctatccctccccccaccccatgacaggccccggtgtgtgatgttccccctcctgtgtccaagtgttctcattgttcaattcccacctatgactaagaacatgcggtgtttggttttttgtccttgtgatagtttgctgagaatgatggtttccagattcatccatgtccctgcaaaggacatgaactcatccttttttatggctgcatagtattccatggacaagcatactgccttcaagcacttttttaacaaagcacatcctgcatagccctaaatccattaaaccttgactcaacaccgcacatgtctctgcgagcacagggttggggctagggttacagattaacagcatctcaaggcagaagaatttttcttagtacagaccaaaatggagtctcttatgtctacttctttctacatagacacagtaacagtctgatctctctttcttttccccacagtaaaattacacttaaatagaagggataagttgtagtgttcgatattacagtagggtgactatagttaacaatgatttattgtatgtttcaaaatagctagaagagaagactgggaatgttcccaacacaaataaatgacaaatggttgaagtgattgatattccaattaccatcatttgattattacacattgtattcatgtatcaaaatatcacatgtatccccaaaacatgtacaattatcgtgtatcaatttaaaaatacatcatgataggcacctctcaggttgactgtactgtcctgattattgctagtggtgttaacaaatttgaagctagtatctttaagaacgggcagacccatgagcatgcccttctggtttacacactggaagtgaaacaactaattgttggtgttaaaaaatggatttcactgaactatgccatcgccaacagagctatgtggaaatcaataaggaagtcagccctacattaagaatactggctacaaccgcaacacagtagtatttatgccaatttctggttggaatgctgacaacttgctaacatgccttggttaaagggtggagagtcacctgcagagatggcaataccagtgtagcacaccgcttgaagctctggattatatcataccaccagctcatccaactgacaaggcttgtgcctacctctccaggaagtctacaaaattggtagtattggtaatgtctttgtgggcctagtggtgactggtgccctcaaacccagcatgattggtcagctttgctccagttaacattacaactgaaataaagtcttttgaattgcaccatgaagctttaaatgaagctcttcttggggacaatgtgggcttcagtgtcaagaatgtgtctgtcaaagatgtttatcatggcaatatggcttgtgacagcgaaaatgactcgccaacggaagcagctggcttcctgaaccatccagcccaaatcagtgctggctctccacctctgttggattgtcacacagctcacattgcttgcaggtttgctgagctgaaggtggttgatttccttctggttagaagctggaagatgacccccattgtgatttttattgctatggtttctttctaatttagtcttgaggtctctcccttgagaatggtcataagccaagagagccactttctaggagagtcctgaccagggggaaagttaagtttgagtgtgtcagcttggtgagacacaatgaggaagtaaaaacaaaataaatagtggaatagaatactaacaagtacctagaaataagtctagctaaaaatttgcaaaatgtctatggaaaaaaaaactatggaaatttactgagaaactttaaagagtacctaaataactttcaagatataccacgtacatgaattggaaaacatgatatttgaaaatgtcggttattcccaaactgatttatagattcagtgcaacctgaatgaaaatcccaagacgttccttttgtagagctcaacaagctgattctaaaattaatatgaaaatgtaaaggtttatgaatagccaagtccttcttgaagaggaagaataagatgagagtaattgctgtctaatatattgagacttattttaaagctataataattaaaacaatgtagcagttggtatagggataatcaaacaggtaaatgaaatagaatagaaaatccaaaactagtctaacacatatagaaacttgatttatgacaaaggtgtcacagaagtagagtttcaataaaatgctggaaaatgttggtatctatatagataaaacattacattggattcctaactcacaccatacacaaaaatccattcacattgcattacaagtctaaaagtgaaatataaaatcataaacattttagaaagaaaatgtaaaagaatatatcaataaccacagggtagggaaagaaagagaattgacatcaagatacaaaaagccctagccaataaggtttttttttataaattccacacattaaaattacaaacttatgctcatcaaaagataacataaaaacaatgaaaagattagccacggaatggtaaatgtttgcaatacataacacaaaggacacacaaaggaaacttatataatagattttaacaggcttctctgtgtccttcttctccagcaatcaaggaatatataaaaaagcatatcaaggatatatagggtactcttttgattcaacaagaaaaaagcagattatccaagagaaaacttggcagaaaaaagcttggataggtgctccacaaaagaggacatccaaatgactgctactcataagaaaagatgctcaacctcatagaacatccaaaaatgtaaaaacacagtcaataccagatatttgtaataatttggagcaaatggaactctcatacattgctaatgaaaatggaaaatggtccagctgctttggaaaacagtgtggcaatacctaccaaagccaaacacatgcatacctagtaattccgcccaacagaaatgcacatatatgttcaccaaaagatatgcaccagaaggttatagcaggtccatatgaaagtgccaaagattataacaactcaaatgtccgtgattagggtatattcatataatactatacaacaatgggaatgaacaaactatagctacatatgataatatagatgaatctcacaaccagaatgctaagtgaaagaagaaacaaaagaatatatgtagtatgttttatttacacacttcaaaacaggcaaaactaaactatatttttaaaggatgtatacgtaactggtaaaattataaagaaaagcaaagaaatgattatcataaagatcagaatggtggttaccttcagtgggaagggagaaagtatgattgaaaagggacatccagtgagtcttgtgggttgttggcaatgttactgatctgggtgatgattgcatttatgtaccaaaggcatttgtgttttatgcactttattgtatatgttttagttcacaatttttttagttcacaattttaatagggctttaaaaagtaaaaagaaaagagatccaagggcttgaccatgggactctcttatatttggagtatgtttataaactttacattcattcaacattcgacaaatattttttgagcacctactttgtgccaagcaccgttacaggtgctgggaatacaacagggaacaaaacagacaaaaccccagctttcatggaacttacatgctaataaagcttggcaagagtatttcaaggaagatgaagtggttaactatgcaaaatgcttctcaggcacctaggaaaatgaggatgtgaggcatttctacccacttggtacataaaattattgcttttcctctgctttttttctccagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtgagttaaggacagtggaattacaagaaaattaattttatatatttattttcttgctgactataatgtattcccacttttggaaatttttaaagtatagaaaaataattccataattatctttgtgtacgttctatttttcctatgtatttttctccttatgtattcaaattataccatgcagaattctgattcttgtttttttactaaatatcacatcataaacatttcttacgtcattaaaaacacttcctatgtatgtttttaaaatactgcataatagtctattatatgaatttatggaaccatagtttatgtaaccatttattttgaacaagcttttagacagtttcttttttcactatataaataacgctgtaatcacaacagtttttctaagataaaattccagaagtgcaatgtatttgagcatcttaagagtttttcttattaattatttggtaatgtcccttgcacatttgtctttcatggaggaagtgcttttcttattgattatgttaccttatatattagatagtaaaccactgaacattttaatgagaggtactttttcaagtttttgttttctcttaattttataaatgatggtttttgaaataaaacaggttttaatttttaggtagtaacccatcaatctttactttttgacactttcattgcttttatgtttataaaaattcctgcctatccagagattttttaaaaaacacctatactttcctcagtttttctcttacagtttaattttttacatttaactttttaatacttcctgtagactaaaagttattttggtgcattgtgtgaaccaaagatcaaagtagttttatttttttctgaaaatatctattcgttgtttcaattaattgatggtgtatattaaggatgtagaaggatctaaaattatggaattgtgggcaatttttgccttacattttattttactttccattatattctatgataaatatgtataatttttaatctggaaagtaagccttttttaaaagataatatgcattcattctagaatttgtcatgaagaaccttaacttacatatcaactcctggcgttatggtctcttataacccctgcagtaacattttcccttttactctggaatggcttttatgtgtttaggaattttctcctttgcaactttgagttcataccttaaatttagaatacaaaacctcctcaggattaggtttgagttctaacagcatccatcttctgtaccacttcttccagggtattaaaaactttgataaagaccaaaagacaggtatttcttttagggatgtaaaccctaaggaccttaagatcctagaagattattcttgcttttttttttttgtcgttattgttctacaggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggtaagcaggtgtctattgtgctgaccactttttggtttaaaagaaatggtctttgtgtactaagaattttgatatttatcctacgtgcaataagaagctttaaataggagagttgatcattatatttgtgttttagaaatgtcattctggaatctactgaagaggatggattatatttttggaaggtgggaggcaggttggactggcataaaaattgatgagaaatccactctggttcataggtgagagagcttatactcataggattgatgtcttccctccctaggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatggtaatatattccacatccaaacattatcactgtgaaatgcagattgcactttgacaaatgagacttgatccagggacttgaacattgtatttatttagagtatatctgtgggagtggaatcctcatagatgtcagtttttttggtggagtggagagaaagaaacttatataatagattttaacaggcttctctgtgtccttctccagcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtatgagcttgtttgtgctctttcttctacctactctatttgttgagtacttactttaaatggtctaggcactgggaacacaatcagtgatcaaagcagacaagctccatgctcttaagtaatactttttcaaatgctttttaaaccatttgttcaaagcaaatgaacaagataatttcagatatagaaaaattgctaaaaaggaaatagaacagaataaatggataattaatgtcacagtactttcctagggaaaaggaatttattcctttatcatttaccatctcaaatcccatagggcaccagtagtcatccaaagagtcatttgtttatgtatgtaaccagtatattgattaagcactactcataatgttgatcacaacacaattttattttggttcttcactgtccctttaaaatagatttggccaggtgcgatggctcacacttgtaatcccagcactttgggaggccaaggttggaggattgcttgaggccaggagttcaagaccagcctgggtgacaaagcaagacccccatctctacaaaaaataattagccagacatgtggtatatacctgtagtcccagctacttcacctacttgggtggctgaagtggaaggattgcttgagcccaggaggttgatgctgcagtgagctatgaaagtgccactgcactcaaacttggacaacagagcaagaccctgtctctaaaaaaaaaaaaccatccagtttaatagcgggggtaaactttccttatttcttcgtaaaaattctgataagccctgtaacttttctgctcacccttaagtaataaacaggactaaagtcactttatgtcacaaatacagttcaaatcagaaattacaatgtccatcccaagatattaatcaaaattgtaaacttgatttaacttcaatctcccctcctccaacttgagcctgcatcaggctggaagtctgcattggaaaagggagacatggttgagtcctctgtttctgtaccttgtgatgatcgtgcttccccacaacccctttatagctgctgttttgaactccaacatggataggttaaaggtaaggggataagatagttcttacctatttacagctggcaccattgttgtaaactagcttaacactgtttgtgcctggcaatacttgttgactctttctcctgcagggcactttcagggaactctttagagactcccttacgtgactgtcatgaaatccccttgacatgatttcttccacctttactctgggtggtcacttgtgactcatttctcagccctcagtgttcacctgcagcttcttgttgctggggtaactttacccttgtaggcagctctagtggactggatccagagggaactcaccctgacttatctgtttcacagagtccacatctggccaatgggaaacacaccttttgctcagaaagaccctgggaatgtaggtcaatcataatgcagtagcattctcctgtcccaaccatcaaagaattcagtcaccctgtttctcatctcctggggggaggggagtggtcagaactcaatctccacaacccccaactgtaagggtcacgtagcaagcactttgcatttgaggggtccaaaagtagtggaactaccaaatttggtaggtctactctgatatttcgcataaaccaatgtatctcatgctcattttttagtgaaaagaaataatttctgttcctgttggtttttataaggtgtttttgagacagtggaaatgttaccatccaaagctggaatttggcgggtggaatgccttattggcgagcatctacatgctgggatgagcacactttttctggtgtacagcaatagtgagtagcaatgtgggcagaggttccctacctactcagcctacttctttacagctttcttcctttctggaatggttgcttgtgtcaggaaataaatacaagtttacatcattatcaaatttaaaatgaatattgctggtagaaatcatcagagttctcagagtagggcagatatacttgaagctttgaacactttgtacctgaagctctaaataattgacaaaaaaaaaataccacctcattttcacaacttggtaaagctcgaagatctccagtagcagattttggaatttaatgttgatttagttaccagataacttagaaatactacttggaagagtttggagatttaaccctaaacaagtaagagagccactggtctatttatgtacggaccccagtttcttcagctgtaaaatgtgaatcattctagcacctgttaggattaattaaatgaactaatacagtaaaacgttgagtacagttcttggcacatttaaacactaaaaaatagcatttgttgacgttctcccattttcattgacttacatttgagaagctgaattttgtgcacttctagttactgtgttccacccgtttcatttcagagtgtcagactcccctgggaatggcttctggacacattagagattttcagattacagcttcaggacaatatggtaaatactattatttttgctccaagaacctgggctgattatatctttttttaataatctggtggagaatctcagataatgaatccatctccatgcttctattagttctattccataagtgcctctcaaatacatctcctcctctccacttcccactgtggccatcttaactcaggtcaccatcatttcttacctgggcaatgacactgcctccttaaatatcctccctaccttcagtatttcttccttgagtcaattcttttcagtgcagcaggaagctatactttcctatgagcagtaatggtaaagtttgactagggtctatagagaattctcagaaattgttttagagcactactgcccacaggctaaatgcagcacactgcctgtttttgtatggcatgtgagctatgaacagattttccatttttaaataattgtcaaaaagatgaagactatttcatgacatgtgaaattataaaattcaaatttcagcatccgtaataaagccttattttggaacacagccacgtccattaatttacatatcatctatggctacagcagcagtaacatagttgcaacagagaccatataatatgcaaagcctaaatgatttactatctggccctttacagaaaaagtttgccaacctatgttgttgtgaggtaaaaaaaaatcctcttgaaaaggaggcgtgagagttttacaccaaaatagtaacatttttcactaggtggaagggttacattttaaaatgtcttttatttgtatttttactaatttttacttttcattttctgatttttctacaatgaacatacattgcgtaataaataataggcggggcacgttggctcatgcctcccagcactttgcaaggctgaggcaagcagatcacctgaggtcaggagttcaagaccagcctggccaacatggtgaaactccgtctctactaaaaatacaaaaattagtcgggcatggtggtacgcgattgtagtcccagctacctaggagactgaggcaggagaattgcttgaactcaggaggtggaggttgcagtgagccaagatcatgccattgcactccagcctgggtgacaaagcaagactccatctcaaaaaaagaaagaaaagaagaaataatattattatttggtagtgttggtaacaaattgcagtatcagctagttagaggtgctaacaattaacaaaattataaattttagaaaataaaatggacaacaaggataagcaatatccttagatagtaattgatactggtatgccataaagcctttatgtttttctctattttcaccacagcttagattaacctttctcaagacaataattttattctcaagtgtctaggactaacccagctgaatttaatctctgtttctttacttgggcaaaggacagtgggccccaaagctggccagacttcattattccggatcaatcaatgcctggagcaccaaggagcccttttcttggatcaaggttagaaaatgtaatcaatgatgggaaatgtatcacattcaatcaattgcattacttattcctcttgcaagctcaaaggattctatgaatatgagaaaactaaagaacagaatgccttaatgatttgtacaaaagcagtcatgaacaaagagatatggggatagaattgagtatattgatatgtcctgtttctgtattttagtccttctactgggattagaacatctgaatattttctataatattgaactcgtcatctctcaagacagtatatgttattattagatgcttccaactgcccacgtgtccttaagtactccaatcccctttattttaacataaaacaaatggttcacaaatgcaaaccacatgtgtacttttacattttctgtagccacgttttcaaaaatgtgaaattcactttaataatacattttatttaactcaacatatctgaaaatactatcatttcaacatatgatcaatgaggccccttcaaagacagacagatggaaactcttgggtctcttccatgcctcacaaaagctgagggcagcttggaagtgcctgctcagcctctccacctaaacataaggctagatgccttctagaagcccaaacaggaaatggagaaaacattttggtttccatctttgcaaatagcatgtctattaatgccacagcattgttttgtagacactgccaattttgactcaatctgagctgctgttcactaatccctaagtattttttgttggtttgtgcttctgccaaacaacatgttatgttcttcaccttgtatttctatggttattttcaaccttaagtgtatccctatatagagaacatgtttatctatttggccaccctgtgtctgtctgtgctatttaattttttgtaataacattcttatttgggagggcggaattatatcttcctcactagatacaacctgataagactagtaaatagagtgtcctgtctgtgcctagccaatgaaccctgaatgatatactctgttgtttccacttactagatttggcccattgtttcagcttgccgatcttcagtgtcccaaagtatttcctagtttttccagttactgatttgatcagtaaactttctaatactgcagcaaagtcatgatcaaaatattgaagtagacaagacttccttagtatgtgcacaatacaaatcaagctgttaagtccttactacaaccttgtgaggtagatgttactatcatcttcatttcagataatgaaattgaagcatagagaggttattgtggcccaagtcacatggctaataagtgactgagccaaaattcaaattctgatagttgggctccagaaccctaactggtaatcgttgtactacactgtttccggaatgctccctttaagttgataaccatctattaactgtcactgttcacttgtggtaattaaaccagttacaaatccacctagttatgttatcatctaccactattgaatcgccttatcttcaaggtggttttgccatctgtcctactaaggtccagctagactttttatagatctcgtaactttataaaataaaccatggagatggagttgaaagggggtgctgacaaggaagggagttggagaaggcatctattctcgtgagaaggcctgaagagtgcacaacagcctggccccaagacacaagagcactgggctggcttgaggagcaccaggtgaccaagaccaggcaatgcacagggggaagtcagcaggccccatggagatacgcagctgcagtgtttgtacttttatacagtgaaactcattaccaccttgcttacttcctagtagagagatgtgtcttgtagttacactgaaacacctggctgggcacataggtgaagctgttgagtctgtaattgtcaaactgctcccaggtgccaattataatgtagaagaggcacaagaagatgaagtggataagcctggcagtttgtcaagcattcatcagttgtcaagcatttgtcagttgcagaatgtaggtaggctgccaaggctttattgtagcctggttctattgcagctttattctagcaaggctgctggaaaatacaataatcactggtccaagaaagaactcttatactctatctatatgaagaaacagtaaaagtcaattcagtagaaatcatgatttttgtgcctggtgctttcacttttttatgccacaataccaagaggttaaaatgaagtgtctttgattgggaataccatctatctgggaaaagacagggctgcaacttctgaagaccttgacactctgtcctgttaccctgcttcatttttctcctgcgcttatcactacttgatgctataaacaaataaaaacatatatgatataaggtctatttctcctactcaactgtaagttccatgagggcagggctttctttcttgtttactactctattccctgtatctaaaacagtgcttggcacatagcaagtgctaaaaaatattctttgaatgagtgtatgaatggaacttacagtcagctgaaggagacagttattaagcataagagtgatgaccagtccaattgtgtgtgtcaggcatgtgtgaaaacgtgctaaatttgacttgcttattaggacagtaactgatacttctaatgttcttgcagcccatgacctcttctttaagaagtgtccattctgtactactttcccattattcactcattcattccaaagcatttgctatacagcagtattataccagataccatattaggtgctggggctagagagaatataaaagctaacattgattgagtgtttagtatgcgccaggccctgaactcagcacattacatgtattaactctttaacccctatggcagccctttgagataaaaactaatattatcttcactttacagataagttgagacacagaaagttaggtgactcaaatgggttcactgccttaaggatctcagtctaataaggaaagcagaaaagcaaagcaaccttataatatggtgcaataatttgctataatgaagttatatacaaagtgaagtagaagcatagaagaagcagcactaaatttgtctgggtgagtcagagaaggctaaccaggaaaaatagtttctgaactaacacttgaaggaggtgtagcagttcatcactgacagtgatgttggggtgggtctggtttcaggagaggggaggaaattggctttggtctgaggctgaggtgtgggcaaagcattagcttatgtgggtccattagcttatgtgagtccacaaaaggtgtgtgtgtgtttgtgtgtatgtgtgtgtgtgtgtgtgtgtgtgtgtgtgtacgaaatgggggctcaatgatttggtagtggtttggtttgtcaagaagcaggctgggaactcaataagcatctttccattcatttctactgtgtatcccacagcttcacacacacatgcacatttcaacattggtgactgcttcacttgcacacctaaggtaatgatggacacacctgtagcaatgtagattcttcctaagctaataattagtttcaggaggtagcacatacatttaaaaataggttaaaataaagtgttattttaattggtaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtatgtaattagtcatttaaagggaatgcctgaatactttaaagaattttggcagatttcagatattggacaaacactcttagcttccacaaacttaattccaaaaaataatttttcacttatgagcaatagagttattacggacatatcagcaaaaatgtagtagtgtcaaggctcatagatgatagaaatgaagagatgctgtattgatagaaatatgtgattcaggactgtgtggattgatgattgtgagcttgcttatggatatcctaggtttgaggttatagtaggacaatcaggttgaaatgtccagcaggcagtaggtgaaagacaagtttagggggcaaaaccatggatggagatgaagattcatgacttccacataaaaggatgggtgaaactttgggaattgatgaattctctagaggtgagctcaagacccttaaaggcttaaaacctcagcgttattgtctactcttccctcatttttatgcccacaaatctggtcaatcctttatttgcaatgcctctcacatctctttcttctgtttccatttataccgctgttgccacagcccagggtcccatcacctcacacttgatctattgtattacattcctaactagtcttcccccgtttctaatctgttctccgataaaagctgcacatcattttcaggataatcatcagtcgcctgcctaaaacttttcaatgtcttcccattgtctttagaataaagttcaaagtcttcaaatgaccccaagcaagataacttttgtttgcccctttagatccattttcctgcttctctaccctgcttcttgttctgtgaggtgagcttgtatagaatacatcaacaggttaccttgtcctccagcttttggttggatttcaccaacagggagcactggcaaaagattggcatatttattcttctgactttctccttgcagaggagttcactgtatctccccacttaaggtcactgtttccctcagagtggctttttctacctgtactagctactattgctgtgtaccaagccacttcaaaacttgctgtcataacaataaccattatgttttgctcacagattctgtagatcaagactgggacacagtggggatgggtggtttctggagcctcagttaggattatttaacagctgggtgctggaatcatctggaagttccttctcttgcttttctggtggttggtactgactgtcagctaggacagaatctggggttgttgactgatgtaactttacatggattatccctgaggcctggccttccttacagcatgtttcaaggtagttggacttctttttgagggggggtaggaaggtggggggaggacagagtctcactctgttgcccaggctggagtgcactggtgtgatctcggctcactgcaacctctgcctcccgggctcaagtgattctcctgcctcagcctgctgagtagctgggactacgggctcatgccaccacacccagctaatttttgtatttttagtagagacagggttttgccatgttgaccaggctggtcttgaactcctgacctcaggtgatccgcccacctcagcctcccaaagtgctgggattacaggcacccggcctgtagttggacttcttacacgtcattttagggcctccaagtgtgagtgttacagttaacaaggtgaagactacataaccttttctgaccgagtcttctaagttatgtagcatcacttttgttgacaaaaagtgttgaactctataaaatatttgaagagatttattctgagccaaatatgagtgagtatggcccatgacacagccctcaggaggtcctgagaacatgtgcccaagatggtcagggcacagcttggttttatacattttagagaggcttgagacatcaatcaaatacatttaagaaatacactgatttggtccagaaaggcgggacaactcaacctgggggcttccgggctataggtgaatttaaacattttctggttgacaattggttgagtttgtctgaagacctgggattgatagaaagggaatgttcaggttaagataaacattgtggagaccaaagttcttttgaagtcttatagtggctccccttagagacaatagatgacaaatgttttgtattcagatcttagttaatctctttaggattgggaggggctgggagaaaaagatctagctatgttaatagagattctttacagttgcaaatttccctccacaaagaacagctttgcagggccatttcaaaatatggcaaaaaaacatgttttggggtaaaatattttgattttcttccttgtctcataatgttatgccagagtaaggttggaaagtaaatcatgacatataaggttaaataaaacccatctgatgagaatttatgatttgtagggcatgactccccagaccccttagataggaatttgggcaagataaaaaaaaatcagagtttagtcctcactttcaatacattctattggttataagcaaatcgcatatccacccagattcaaggggaagagacatagaccctaatttttaatgggagaaatgttaaataattggtggtcattttttaaagccactacaataatctatccaattctctctttcaggatgtttctctcttctgatcctttcaggtttagggattgtcaacaaacaaaaagttaaaccctgtaaaatacttgaagagatttattatgagccaaatatgagagaccaatggcctgtgacacagccctcaggagatcctgagaacatgtgctcaaggtggtctggctacaacttggttttacgcattttagggagacataagaccgaaatcaatagatggaagatgtacattcattgagtttggaaaggcaggacaactggaagcgaggcggggcttccaggtcgtaggtagattcaaagattttctgattggcaattggttgaaagagttaagttattgtgtaaagacttagaatcaatagagaggaacatcggggttaagataaggggttgtgaagaccaaggttctgtcatgcagatgaagcctccaggtagcaggcttcagagagaatagattgtaaatgtttcttatcagacttaaagagtctgttctatcagtctgaaggtctgtgttgatgttaatgctggtcagatttttctgaattccaaaagggaggcgggtataataaggcatatttgatccccactttcccatcatggcctgaacgtttttcaggttaactttggaaggccctttgccgaaaggaggggggattagaattttattttgggtttacaggatggtaatactctgttcccaccctcctaactagtatctttattaaaccttccacaaattatcctaatttccatgttttctgttccttgctggatcccttgtttcatacagtaattggtgctagaagaaaccccaggaaacagattttcaaaatgcaattctaaggttatgttgctaatatattcaagaaacacagagataacatatttgccaaggaagaaaatgagcagttagggaatccatgacatgtgttagtattatagtttctcagattatcaccagtgatactatgggatgagttgcagatggcaagtaagacactggggagattaaatgacagtggcatttagtcactgtggcaacaaacgtagcattacctgattgtagagtggtctgtcttcttacagccctagagggcatacacatggaaaaagaaatgaaatgttatgaatatatacaaaataagaacactgatgaacatacatggaaaatcaggatgcatgcatagagcttttgaggaatactccgtatcctgtggttgtaggcagatacgacttaggggctgagcataagttgcagagctgcagtgacaattaaatgcttaactccaccagatctattatgctgtggtaagagtaccggtgggaaggagtgaaactctgaggcctgagatggaggcatttaggcagacatggatgaggctgagaattgcaaacctccaaattcccctgaacctcctttgcctgaggaggcaaccactccccagtctctgaagcagtcatccctcttttgtgtaaaagcctttcagtggctataactgagataggtgcctcacaaaccagtgactattctccttagagaccctgtttggacactacgaaagccaggcgagtcacagaaaatgacagcagatcacaaatttaatcaggtggtgatgccaaaaaacaattgcaattccagatatcatatctctgttgaagcaaatttacacagccccaggcacctgatatggaagtattgacctagagaatgttttttcttcatttccatacattagtaaaatcagaatacatttgaatttaccaagtaggaacaagagtattaagtttactgcccatgcatcagggcaatgttagctctcttgttttctatcataatatagactcaagggacctcaaacatctttacatcccacaagcacaatgcctgtccattacactgatgacattatgctgacaggatctggtaaacacataacaaataagcctgtcttgctcttgactttaatgagaatgtaacctgtgtttcactgtttaatataatgttcactgttagtttcaaatactttttatgatgtttaaaaagttttctcctatccctattttatttgcaatggcaactgaattttatcaaatgcttttccagcatctttgacatggtcacatttctcttttgtgttgtcaaattatacttaacattcaatagtgtgctgacaagaaattaacaacccacaggggagcaaagtgagaagaggttaagaagtaaaggccttgatttatagcattggcagatttccctgacataaatactactcccatcatgcctggccccagggatgggaagagatgcttacttacaattggctctcacagaccagtgcaagagcactactgtgctccatttctgggaaaactttcgtcagtcatagtgtgttagttatttaaaacttagctggatccaatttgccaacatttcatttataatttctatatctatattcatgaatgaaatgggtttagctttttcagtagctctacttaccaggttttggcatgagggttatattaaacttgaaaataaagtgggaaagcttccatttttttccatgaagactattgctctagaatagcttatttaatgtaggaatccagtatttaatgagagtaaatgaaaaagccatatgagccatgtgctttatttagtgagagatactaggctatattttccaatcgttatatgattattgctattctcatttgtgttgccttgagttaatgtctgcaaatgtgcacattagagtcatatatcccttcctgtgccatacatctatatctgtatacacacatatgtcttttctccttttttcccttctgtatcaagagttggcaagtgtttgtctattctattaatttttcaaagaatcagctcagttttaaacccaaacgtggttttgaaagagctgtttctagttcatcaatctctgttcaaaactttaaaaattctattttcctttcttttggtttgtttcctacaatctggaggtgaatgcttagttcacttattcttcaatctttgtattttaacgataaggataaattacttacagttattaactactctcatgaggttcattccttgaacagtcactgagcaactactatgtcctgggttctaattcaggggtgggcaaactatagccccagaatttggcccatagcctgcttttgtacggactgtgagttaagaatagtttttacacgttgaaaggattgcaaagacaaacatacaaagaaacaaagaagactgtgcaacagagaccacctgtggtctgtaaagactaacacatttctatcccgcccttgacagaaagagtctgtgggctgctggtctcctctaacggtggtagagatgcctgcacggttaacattaatccttggcaccagaatcctcagcacctaggaaccagatcttgcctaacacgctaatttcagtcttgaccaccttcctccggcgtagcggttctcaaacgtctttgtctttgtactattcacgtataaaatattctttcataagcaacatttatccttttgggaatacctcacaatggggagaaggggaaccccaacagcctttaagggttcactgcttcgctgccaccatttccgacggtttacactgttttaagtgtgaatttggaattgttttcaagttaaaaagcaaactaatcatgtcctctgaaagtatttgcttttggcatgctagaaatcagtgttgacttttgatactgatgtgatacattacgagggaattctcaaaactgctgaaatctggcctcggcccagttatcactgctcttaagcttctgagggagatacatgaatgagcccacggcaaatggaaaacgaggagttttagtgtttcctagaattatgctcagatacccactacctgaccgtctggttatccttcccctcacctccctgacgcaaggagtttggaccagaggcctaaggaggcttctcctgaagcccaaatcccaaactggtcaccagtcatgctccgtaactcctgaacctgacaagaagccagccggccaggtctgcagcccgggttaagaggagcataccaggaaagagccaaagagcaaaggagcatgagcccttcaaccgcttttacaataatttgggctaggcgttcagggctccgtaggacccttcctggcagccaagtgagagaaagaggaatgatggtggaatgggcctctcctgtgcttcccattacttccacactgtcgaaatagaaatagaagcagaaaagaacaccctacaagtcccacccatttggaggcactcaactcacagtgacaaccctccacacctctcccctgcaaaaagacgcaaaacaaaaacacctactccaaactgtgtccttacatctcagccccgaagatcaggattgtgtgcaacttcggcccaaaggatgcatttccccagggttgaaagtttgagaaagaggctatattctgaagagttcttgttgtcaccatcaaaaggattaaaaagacgcaataaataagaaaacagcgtagttggggggcatgctccatttgagccagaaagccttggaaacttaagtgttctcaaacggaacgccatcctgctttgggggaacacggaggctgccttgcagtcacgtgatcgcacaacaccaaagggccacgcactctgatttcacctacttaactaaaagttgcagcaaaatccctattacaggccaggcgtggtggctcatgcctgtaatcccagcactttgggaggccgaggagggtggatcatttgaggtcaggagttggagaccagcttggccaacatggtgagaccccatctctattaaaaatacaaaaattagcccagcgtggtggtgcacgcctgtaatcccaggcaccctggaggttgaggtaggagaatcgcttgaacccaggaggcggaggttgcagtgagccgagatcacgccactgcgctcctgcctgggcgacagagtgagactccatctcggggggaaaaaaaaaaaaaaaaaaaaaaaaaatccctattacaaataaaagctgttgtgatccagactgcatatacctctgcgaatggaaccagaaccgtgaattccaatgcaaatcgatgcatcggcaccagacccgctgcactggatgtatctgcattgcagtcacccgagtacggagcacatcatagatgatctctgcaggttcgttgcccacataggaggcatagcgcaaatttcaaaggaacgaatacatcctggagcccaaacagctatctggttctgctgctggcctcctgacaagtaggtaagagagtcacattttatagacgacggacaccaaaaccacacatgaggagtacaagagtagctttatcatggatttagggctgtggttacaaggaagctgtaaggaataaaatgactcccatgaagacgtaccgtgcggacgagtggaaggagaaatttggccattacaaagacacaggaatatgttaagaagtgaggggcaggatgaaatcatctagggtaggtatttagagggagggcgccgtgcaaaataaaatcctcactatgaaacaaaggcggaggcaggaggctgcgttaggtggaagcagcggaggaaggagacgaaagggattgtcattttcatgtcgtggctttttagaagacagccatgtcctctactctgattctatcaaaatgtgttctcggggtgctggtaacgttcagccaacgaaataattcctatggcggcagtaggaataacaaaacgcagaagcgggaacgatgtctttttattcctccccagacgcaaacgtggatgcatgaggtttggtaacaggcaaagtcatctggttaacgtgactgatgcaaaaagtccaggcctgggcaaaaagaagtcactgggtgaatgggatggatcagactccctgtcctgagggggagatggtttcttgcagaacgaggtgaaggaggtggttctgctcagcagtcaacagtggccacatctccacctgcagcgacttgatggcttccgtgtccttttcgtgggtagccatgaccaaagactggagcagcagaaagagctcctcgggaagctggccgctgctctcctgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcgggagagggcgccgccgagccggagttcggaggaagcagcgcggccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtagtcgcgcgccagcagctggcaggaggcggcctcgccaagcgcctgcagcgcggccaggggcagctggggcagctggagctgggcggcgcgctggaagtgaccggcggcggcggccggctggcccaggtcgcgcagggcggcggccagctcgaggcagagggcggcggcggcggccggctggcccagctcgaggtgcagacgcaccgcggcgcccagggcgctggcggcggcctgcagcggctccccgtaggcggcggggcagaccaggcgctggcgcgcgtcgcgctcctgccgcaggaagaggcgggcggcctcggtgagggccagcgcctccccgggcccgtggaagagcgcctgctggcagcgcgccaccgccagctggcaccaggccgcgtagggcagacactcctgggcgcgcagctcccggcccagctgtccgaactgctcgccggcctccgccacgttcggcttccgcaggaaccgcttcttcagcttgttcgataccagccggtagcgggccaggaagtccccggcctcgggtcccgggccggcgccgccgccgcccaggcctgcagccgctgccgccatgctcgccgccccaagcacttcccgacgcgccgccgcagctggcgggcgggccggggcggggcgacgtgccctgcgtccccctcggcgggctgccgccgtgcccgcgccggctccccagcccgagcctgccccttgccctgatgaggtgcaaagagcgggatcggaggcggggcctggccgggctgtgagcggcgtatgcaaatcgagggtctcggggatgcggatccaagaccctgggaaggtacgcggggcctggcggggcaccagctgctgctagctcggctgcaatgcaagtggtctaggttgctaaaggcatcccacagcctctccatctgaacatgacccaaacgaaactcgtgaccctaattccatgtctgcgcatttctagactgttgtccccccccccccccgccccgactactcagtcctccgtcttccggtccagggccccttgccaagcaccgggtccacctctccgtccccaccccggttgccttagaagtccgtcctgtcgcaacactgcagtcatggtcttgaggcccacccgccccaacgaacaccatcatgctgaggactttcccgggcaggccctgacttgctcagaaccagcgggggtgtccccttcccacccagggccactcccctgcactgtcacccggagagactgctcctctgtgccatccctggctcccacccaaccccagacccccaccacctctccatccctccagctgtggaggtctcacaaccccccaacccatctcaccgcccccccacccccaccccaaggcaaagtgactgaagcgggcagatggcttccttgaaacattttattgacagaattaatgaaggcccaagactttggggcctgggttgtggggggagggtgtttaaggccgggggttcaggccgggggatttggggccgggtgggtggacgagtggacctgtcaggtcccaggggccgggtgtcagaagctagtcctcgccaggggccacttgagagatggtggtcgtgttgaaaagggtgctcagtagcctgtcgttgtgaaccaccatgtccagcagcaggggagtgatgttccgctctccgctgttctgggcctcgttgcccgccagctccgggaccttggccgtcaggtactcaataaccgcagcgaggtagaccggcgccgtgcgactcaggcgctgagcgtagtggccctcccgtagactgcgctccacctggctcactgaaaacgaaagctccgctcggacggtgcgagagcaggtccgcccccggccgccagcaccggaggaccctcggcgtctcctcctcctcggcatgctgggcgttgagtgtgctatctcggcttggcccagctaggcaagatggctctcaagaggacagttaccgcgtccagtactgtgtatcctagcgaccagggcccagcccctcattggctagggagccgagaccaatgggcacgcacatccggcgacgggcacgcatgtggtgacggcccctcacaagggacacacgtccgtcaggtgacctcatcactttcccattggcctcgagggagcaggcctgggcctagaagtggctggagggccgtgggggtggggtggggcggggcagggggaatcgcgctggtgaccctctctttgccagtgggaactttccctttctactggatgggaacaccgtgggaaagacaaaggggtgggcgaggggaggacgggtaccacgccttcacaatgttgcacatccatcacgaccacctagttccaaaacgttttcaacaccccgaaaagaaaccgaaacccctgtacctataagcagtcacttgccgcacgcctccttccacaccaccactaccagcccccacaccctcccacacacaccccctgcccccgcccatacacacgttcccgatagtccctggcaacccctagtccatctgctttctgtccatagaggttagcctgttctggagatttcctatagatggaattatacgaccaaatgtgaggccgtgtgtgtctggctgctttcacttagcgtaatggtttcatcagggtgcatccatgtagaggcatgaatcactacttccttcctttgaatgactgagtacgattctgttgtatgaataggaggccacattttgtttacccactcgtcagttgatggacaggttatttcccccttctggctattgtgagtggcactgccatgaccatctctctacaggtttttctttgaatatctcttttcagttcttttgggtctatttctagcagtcaaactgctggctcgtgtggtaattctgtttaacttattgaggaaccaccaaactgatttccacagcagctgtaatctttcgcattcccaacagtagtgcatgagagtcccaatttcttcacagcctcatcaaaacctgttttctgtttgcctcattttgttttgtttacagtagccatcctactgggtgtcaagtgctatctcatggtggttttcattcgtatttcccaaatggctaatgatgttgctgtggtttgagtgcatcccccaaattgtgtgtcttggaaacttaatccccaaattcacatgttgattggaggcgcagcctctgagacggtaattaggattagataaggtcatcggggtgagacccccaggatgcgactggtggctttataagaataggaagagaggcctgaaacgacatacacgctcttgccctctcgccgtgtgataccctctgccgtccccagatgccgggtcacttcccagtccccagaacggtaagaaataaatttcttttctttataaattgttcagtgtcgggtattcaattatggcaacagaaaacagactaagacatcttttcatgtgcttcttggccctctgtacctctgctttggaggaatgtctattcaagccctttgcccattttttaattcggttgattgtattttggctgtgggcttctaaaacttattcatatattctggaaaatagactcttatcagatatgtgacttgcaaatgtttctcccattcactttctggatagagccctttgttgcccaaaagatttacatttggatgtagtccaacttgccaaatgaaaagatatctgtggctttgcctttggtgtcatactgaaggagctgttgcctaatccaaggtcgtgcaaagttacatctccgttttcttcttagagttttatagtttcagcccttacatttagatctgtgatccattttgaattaattctttacatgatgtgaggtaggggtccaggggccttcttttgcatgtggctatccagttgtcccagcgcagtttgttgaggggattattcttcccctccacccattgaggggtgccggaactcttactgaaaataaactttacataaatatatgggtttattcctgactctgagttctgtaacattgacctaatgtatcgatcacgatggcagtaccacccttttcggattactgcggttttgtagtacgttttgaaattgggaagtgtgagtccttcaacttttttcttttctgagattgttttggctatctgagccccttacattttcttatgaattttaggatcagcttgtcagtttttacaaagaaggcaggttggattctgacaggcatcacgatgaatctgtatattgccttggagattatgggcatcttaacaatattaagtgtcccaatccgttaacacaaaatgcctttcgatttatttaggtcttctttaatttattttagcaacgtcttgaaattttcagagtatacatcttgtacacctttagttaaatttattcctcgacattttattgtttcgatgctactgtaaaatgaatcatttccttaatcttattttcatgttattcattgctagggtgtagaaatacaaccgactgttgcagattgatcttggatactgcaactttgctgagccgaatatgctttgctgagcatactcagacagggttggcatattagtccgttcctacactgctataaagaactgcctgagaatgggtaattcctaaagaaaagaggtttaattgcctcatggttctgcaggctgtacaaggcttctgcttctgggcaggcctcaggaaacgtgcaatcatggcggaaggcgaaggggaagcaagcaccttcttcacatgttggagcaggaggaagagagagagaacgcacgcaaagggggaagcgctgcacattttcaaacaatcatcagatcttgtgagcgctctatcagaagaatagcaagggggaagtccgcccccatgattcaatcacctcccactaggcccttccttcaacaggtggggattacaattcgacatgagatttgggtggggacacagagccaaaccgtctcagttttttttttttttcttttgttggactctttagtgtcctctatataagaacatgccatctatgcatctatgaatagagatggttttacttgttcctttccgatctggatgccttttatttctttttcttgactaattgccctgactagaactttgagtacgatgttgagttacaagtggcattcctgatcttagggggaaatcaaccagtctttcaccattaagtatgatattatctctgggtttttcatggatgccctctatcaggttgaagaagtttctttctgttcctggtttgttgaatttattttcatgaaagggtactgcgttttgtcaaatgatcctttttgtacatgattaagatgaccatgagccccctcccccgcccccgctccgccatgcattctgttaatatggtgtattatataaattgattttcacatgttgaaccaaccttacatttgtgggataaatcctatttggtcatagtgtataaagagtggtcaataaacatttcgttgaaagaataggagtggatctggcaagcttcttggaggacaatgtgtgtgttaaagaatctgtagcatgatgagaagccaaggcaccggtgggaggaggggagttgcaaccaattcattaaggctggagagtacgatgccagtggagcagtagtggttgatgtggctgggaaagaggtaggcaggagccaagacatggaggttctattatgccatgctcaggttttagaataccctgtaggctacactgaacccactgtggtctttcagcttgggagtgacgtggtctgatttgcctctagaaatatcaccctggaagctgtgtggagaatagaacagagaggattgtgtgtggagaatagaacagagaggactgagattggaattagaaagctgctgtattataccagtcaagaaatgacagatatctcaactaagacaatggcattggtagataagactaggggacagagtccataaaaagtttaggtagtaaaatggcacacagtagacactcactacatattactcatactggtgaacctagctggagacatgataattcatgtgctcattcttcaaaaaatattgaagggtagtgccaggtatactgtgttaagcattgagacaacaccaacgagaaatattctgttgtataaataggccacattttgtttatctactcatcagttgatgaacagttcattaaatgatttccatggcaggggaggtaaatgttgtcctctatcctcttagattctccagctaggacttaaataagatagattaacaaaagaaaagcatacaaaattttatttggcattttttacatgtacatgggagccctcataagaaatacgaagactcaagtgattaattacagctgaatacttacatactagggtgggaaaagtatggtaaattgtgaaaacataacaagacattggggtttgggctaggagagttaattgtggaaaagtcactaagaaggtaagagttgtgtaacaaggttttttggtgcagctttccctcaagcctggactccccatctctggcaataagaatgtgtttcttcttcctggtatacagataatacctttcacatcagagtttcatctcttcctttcatgaaaaaaaaaggaaggtcagtgtgcccttcttgcatctgctactttcaagtgcctttaaacacaaaataatcaatatgccaaagtggcatattttgaggtggcatttgatcccctacattactgattggatagtgtgaatagtgctgccatgaacgctcctgtacaagtgtttgtttgaacagatgttttaaattgcagacgctcctcaacttgggatggtattatatcctgataaacccattgttagttaaaaccattattagtgtaaattcatttaatacagctatattagtccattctcacactgctataaagaactacctgagacttggtaatttatgaagaaaagaggtttaatggactcacagttctgcaggcttaacaggaagcatgactgtgaggcctcaggaaacttacagtcccagcagcaggtaaaggggaagcaagcacgccttaccatggtggagcaggagagacagagagtgaaggacggaaatgtcatacacttttaaaccatcagatctcatgagaactcactcactgtctcaagaacagcaaggggaaatccacccccatgatccaatcacctcccaccaggcctctcctctgacacacggggattacaattcgatgtgagatttgggtggggatacagagccaaaccatatcagcggctaacctaccaatcatcataatttagccaggcctaccttaaacatgctcagaacacttacaattaggctacagttgggcaaaatcatataacgtaaagccaaatttataatgaagtgttgactatctcacgtaatttattcaatattgcactgaaagtgaaaggcagaatggttgtatgtgtactttaagtacttttatgcatatggattctactgaatgcatgttgctttcataccatcataaagtcaaaatattgtaagtccaaccattataagctgggaaccatccatatttgaggtacatacccatgaatatatttatgggtttatttcttgcttcttaattctattccatttatatatatgtctgtccttatgccagtaccacaaagcattgataactgtagctttatacgaagttttgaatttgggaaatgtgagttatccagctttgttattttttaggattattttggctatttgaggtcttgcacaattacacatgaattttaagattggcttttccatttctgccaaaaaaaaaatggccattgggattttgatgcagattgtattaaatctgtagatcactttgggtagtactatcatcttaataatattgtcttccaattcatgaacacaggatatattttcacttctttatgctgtctctaatatctttcagcaatgttttgtagttttcagtgtacaagtcttttacctccttagctgaatttattcctaagtattttattctttttgatgctattttaaatagaattattttttattttgttaatttcatctcagattgttcattgctagtgtgtagaaatacaactgatttttgcacgttgatcttatatcttgcaactttgctgaattcgtttattagctctatagtgttttgtggattcttcggggttttccatacataagctcatgttcatctgagaataagatagctttacttattccttttcaatttggatgccttttatttctttttttcctaattgctctggctaagacttccaatacaattttgaatagaagcagtaaaagcaggcattcttgtctcgtttctaatgttagggaaatatctttcagtcttctaccattgagtgtgatgttagttttgggtattttatgaatgctctttatcatgttgtggattttctcttccatttctagtttgcttagtggtttttttttttttttttttttttggtcatgaaaaggtgctcagctttatcaagtgatttttctgcatcaaccagaatgaacttgcaggggtttttttccctatattttattaatgtggagttgactgggggattgattgtcttatgttgaaccagtcttgcattattgggataatttccacttgagcatgggctataacctttataacatgctgctggatttggtttgctaatattttgttgaagatttttgcacctagatgcataagggaatattatactcacatattcaattacatgcaatttgtaattttcttttcttgtgatatatttgtctggctttgatatcaagatatggtggcctcatagtatgagttgtaaagtttactctccttttctgtctcttggaagagtttaagaaggattaatgttaatccttccttaaacatttagtagaatttaccagtgaggccttctagcacaatgcctggcacataatatatggaatctaggatttgtatagtcagtcattaactatttgttgaattaataaattgtctccccaagcaggtttctaatcaaggcacaaagattgagtaacgaatgaaggcaaagccaatgtatacagggtattagttttctaatgctggggtggcaaattaccacaaacttaatatggcttaaaacaacacaagtttattatcttacagttcgatagggcagaagactgacccaagtcttactgggctaaaatcaaggtgtcatcagggctgcatttctttctggaagctctagaaaaggatcctttttcggtcgcctgtagtcccagctactcgggaggctgaggcaggagaatggcgtgaacccgggaggcggagcttgcagtgagcggagatggcgccactgcactccagcctgggcgacagagtgagactccctctcaaaaaaaaagaaaaagaaaaggatcctttttcctttcttttccagcttctagaggccacacacattcattaactcatggcttccttcctccatcttcgaagccagtaacattgcacctttgtgactattcttaagtagtcacgtctccctttgactctcctcttctgcctctctctctcactttcaaggcctcttgtgattacattgggccgacctggataatccaggatattctccctattttgacatcagctaattggcaaacttaattccatctgcaaccttaaatccctcttgccatgcaacataacacagtcaaatgttctggggattaaaatgtggacatcactgagagatcatattcttcctagcacatacggtttagtcacaagttaatgatcaacatttattagctatataatactcttaagttcaacataaactttttggatgctgataaaacggaatggcattttacattgatatatacttcatttcaaaacttcttctacttctcaatgattattctgtagcaacaaatttcttttaaatcagaaatttggaaacataacgagacctatctcaaatcaaagatgactatccccttttggagtcagactacacattcattattttagtcaaaatgagacataaaattcaggcccccaagagctgccagtacccacttacgcaggaggtagctagacgaaacaggtagctttctacaaatgattttgcaccatcccaccccagagaggtggtttggagtgtttacttattacctgggatttaattatactagctcttgcaaaagccaaatctaaaggccataaatagaaggtcaaattttctcctatatagaaaggagagcagcagagaaaacaaaatccttggtaaatctttaaacaaagttatatggtttgaatatgttattcattctattttaaccccccaatacagatatatttataaaaaagaatattgtgatttctggtataacttgtttaggaacaaagccacaaatttattaatattttctattccctgggaagaaaaaaatgctacatggcagaataattttttaaaatttccagccgggcacggtggcttatgcctgtaatcccagcactttgggaggccgaggtgggcggatcacaaggtcaggagattgagaccatcctggctaacacggtgaaacaccgtctctactaaaaatacaaaacattagctgggtgtggtggtgggcgcctgtagtcccagctactcgggaggctgaggcaagagaatggcgtgaacccgggaggcggagcttgcagtgagccgagatcgcgccacggcactccagcctgggcgacagagcgagactccgtctcaaaaaaaaaaaaaaaaaaaaaattcccatgatactaaactgatgtgtgatcatataatagacttacactgatacctattttagtgtattcaagcagataaaaaatcccaggtgttctatgagtgatatcattttcagtatttcttatgctgtatgccatggtttaaatctaggcctttcgaattggcattactaccatatttctcaaactgtattccctttctcttgaatatgttatgtaattttgtccagaacccagacatgtcaaggtgtcaaatcccacgttttggatactaacgtgtctcattaattcatacagtgggatcattcattaatgcccacattatagactctctctctctctacacacacacacacacacacacacacacacacacacactacattcttagaagatcattctgagaccagggtggaggataggctgtgcattcccagtactctttcacagctgactgtgtcctctgccagtgttttcaaactttactgcttatgaaacagctaagggtcttattaaaatttagattctgattcagtagaactgacatggtgcccaaggaactgcatctcttttaaaaaatctttatttaggtataattgacaaaagttgcatatatttaagaggtacaacttgatgttttgatatattttgtttttcatatatgatgtttgatacattgtgaaatggtcaccacaagcaagctaattaagatatatctatctctttgcctagctacctttttttgtggtgagaacatttatgacctactcttttagcaaatttcaagtatacaatattgtttactatagttactatatcgtacattagatctccagaactaatttatcttgcataattgaaattttgtaccctttgatcaacatctccctgtttcccccacaccacagtccctagcacctaagattctactgtctgcttttatgagtttgaccatcttagattccacatatgaggtcatgaagtatttttctttcagtgtctggcttattacacttagcataatattttccaggttcatccatgttatcacaagtgggaggattttcttctattttaaggccaaataatattttataattgtgggaatattccatcagatatatatatatcagattgtctttatccctccatccatcaatggacacacttaggttgtttccatatcttgactattgtgaatactgttacagtgaacatgggagtgcagatattcaacatactgattttgtatcctttggatatataacagaagtgagattgccagatcacatggtattcatttttagtttttttgaggaacctctatgctgtttttcataatggctgtaccaatttatttttgcagcaacagtgtacaaaggtttccttttctccacattaccaccaacatttgtcatcttttgtctttttgataatagctatttgctatggtttgagtgttttccccaaaaaacatgtgttggaaacttaattcccaatgcgacagtgttgggaggtagggccgaatgggagatgtttaggttatgaggactccaccctcatgaatggattaatgccgattacaaaagcacctaaggctgtgaatttgaattgctctctcttgccctctttttgcccttctgccatgttatgatatagaaagaaggcctttgccagatgctggcctcttgatcttggactgcccagcctccagaactgtgagccaaatacatttctgttcactacaaattactcagtctgtggtattctgtcatagcagcataataaattagagtccataataagttatagtccataacagactaagacactattctaatagatgtgagggaatatctcattgtgttttgatttgcatttccctgtgggttagtgatgctgagcatcatttatctgttggccttttatatttcttcttttgaaaaattctatttgggttctttgcccatttttaattgggttgtttcttactaatgagttgtttgagtttcttacccattatcagatatacagtttgcaaatattttcatccattccataggttgtcttttcactctgttgattatttcttttgctgtgcagaaagtttttagtttaatgcaatcccagtttctatttttgtttttgttgcctgtgcttttggtgtcatataaaaaaattattgcccaaatcaatatcaggtagcttttttcctgttttcttctaggagttttatagtttcaggtcttatatacaagtgtttaatcaattttgagttgaattttatgtatagtgtgagaaaagggcccaatttctttcttctgcatgtggatattcagttttcccaatatcatttattgaagagactctcttttccccgttgtgtgttcttggcacccttgtcaaaaatctgttgactgtaaatgtgtgaacttatttctgggcttttctattctgttcccttggttgatgtgtctatttttatgccagtaccatactattttgattactggagacttgtagtatattttgaaatcaggaagtatgatgcctctagctttgttcttcttgcttaagattgctttgccaggctgcatgtggtggcccacgcctgtaatcccagcactttgggaggctgaggtgggtggatcacttgaggtcagaagtttaagagcagcctggccaacatggtgaaaccccgtctctactgaaaaaatacaaaaattagccaggtgtggtagcaggcccctgtgatcccagctaatctggaggctgaggtggagaatcacttaaacctgggaggcagaggttgtagtgagccaagatcgcaccactgcactccagcctgggcaacagagcaagactctgtctcaaaaaaaaaaaaaaaagattgctttgcctccttggggtcttttgtgatttcatattaattaaaattttttttttatttctgtgaagaacaccattgagattttgatagggatcacatcaaatctatagattactttgggtagtgtggacattttaacaatactaattcttccaatctaggaatatggaatatcttttatttatctgtgtcttctttaatttccttcataaatgttttctatattttcattgtacaagtctttcatttctttggttaagtctattcctaagtattttattcttttgttgctattgtaaataagattattttctaatttcctttgggatattttatagtgtatagaaacaccactgatttctgtatgttgattttgtatcctgcaactttacagaattcatgtattagttctaacaatttttttttgagtctttagagttttctacatgtatgatcatgtcatctgcaaaaagagataattttactattctcttctatttggatgctttttattttatttattttttaaattatattttaagttctgggttacatgagcagaacatgcagttttgttacataggtatacacgtgccctggtggtttgctgcacccatcaacccgtcacctacattaggtatttctcctaatgttatccctcccctagccccccaccccccaacaggccccagcgtgtgatgttccactccctgtttccatgtgttctcattgttcagctcccacttatgagtgagaacatgcagtgtttggttttctgatcttgtgatagtttttgagaatgatggtttccagcttcatccatgtccctgcaaaggacaggaactcatccttttttatggctgtatagtattccatggtgtatatgtgctacattttcttaatccagtctatcattgatggacatttgggttggttccaagtcttcgctattgtgaatagtgccacagtaaacatacatgtgcatgtgtctttattgtagaatgatttataatcctttgggtatatgcccagtagtgggatttgctgggtcaaatggtatttctagttctagatccttgaggaatcgccatactgtcttccacaatggttgaattaatttacactcccatcaacagtgtaaaagcgttcctatttttccacaacctctccagcatctgttgtttcctgactttttaatgatcaccgttctaactggcgtgagttggtatctcattgtggttttgatttgcatttctttaatgaccagtgatgatcagcattttttcaaatgtctgttggctgcataaatgtcttcttttgagaagtgtctgttcatatcctttgcccattttttgatggggttgtttgtttttttcttgtaaatttgtttaagttctttgtagattctggatattagccctttctcagatggatagattgcaaaaattttctcccatcctgtaggttgcctgctcaccctgatgatagtttcttttgctgtgcagaagctctttagtttaattagatctcctttgtcaattttggcttttgttgccattgcttttggtgttttagacatgaagtctttgcccatgcctatctcctgaatggtattgcccaggttttcttctaggatttttatggtcctaggtcttacgtttaagtatttgatccatcttgagttgatttttgtaaaaggtgtaaggaagggatccagtttcagttttctgcatatggctagccagttttcccaacaccatttattaaatagggaatcttttccccattgcttgtttgtgtcaggtttgtcaaagatcatatggttgtaactgtgtggtgttatttctgaggcctccattctgttccattggtctgcatatctgtttggccccagtaccatgctgttttggttactgtagccttgtagtatagtttcaagtcaggtagcatgatgcctccagctttgtccttcttgtccaggattgtcttggctatgagggctctttgttggttccatatgaagtttaaagtagtgttttccaattctgtgaagaaagtcagtggtagcttgatggagatggcattgaatctataaattactttgggcagtatggccattttcatgataatgattcttcctatccatgagcatggaatgtttttccatttgtttgtgtcctctcttatttccttgatcagtggtttatagttttccttgaagaggtccttcacatctcttataagttgtattcgtaggtattttattttcttagtagcaattgtgaatgggagttcactcatgatttggctctctgtttgtctgttattggtgtataggaatgcttgtgatttttgtacattgattttgtaccctgagactttactgaagttgcttatcagcttaaggaggttttgggctgagatgatggggttttctaaatatacaatcatgtcatctgcaaagagagacaatttgacttcctcttttcctatttgaataccctttattgctttctcttgcctgattgccctggccagaacttccaatactatgttgaataggagtggtgagagagggcatccctgtcttgtgccagttttcaaagggaatgcttccagtttttgcccattcagtatgatattggctgtgcgtttgtcataaatagctcttattattttgagatatgttccaccgatacatagtttattgagagtttttagcatgaaggggtgttgaattttatcgaaggccttttctgcatctattgagataatcatgtggtttttgtcattggttctgtttatgtgatggattatgtttattgatttgcatatgttgaaccagccttgcatcccagggatgaagccaacttgattgtggtagataagctttttgatgtgctgctggatttggtttgccagtgttttattgaggatttttgtatcgatgttcatcagggatattggcctgaaattttctttttttgttgtgtctctgtcaggttttggtatcaggatgatgctggcttcataaaatgagttagggaggattccctctttttctattgtttggaatagtttcagaaggaatggtaccagctcctctttgtgcctctggtagaatttgtctgtgaatccgtctggtcctgtactttttttggttggtaggctattaattactgcctcaatttcagaacttgttataggtctattcagggattcaacttcttcctggcttagacttgggagggtgtatgtgtccaggaatttatctatttcttctagattttctagtttatctgcatagacgtgtttatagtattctctgatggtagtttgtatttctgtgggatcagtggtgatatccccaatatcattttttattgcatctatttgattcttctctcttttcctctttattagtgtggctagaagtctatctattttgttgattttttcaaaaaaaccagctcctggattcaatgattttttgaaggtttttttgtgtctctatctccttcagttctgctctgatcttagttatttcctgtcttctgctagcttttgaatttgtttgctgttgcttctctaattctttaattttgatgttagggtgtcaattttcaatttttcttgctttctcttgtgggcatttagtgctgtaaatttccctctaaacactgctttaagtgtgtcccagaaattctggtacgctgtgtcttcattctcattggtttcaaagaacatctttatatctgccttcatttcattatttacccagtagtcattcaggagcaggttgttcagtttccatgtatttttgtggttttgagtgtgtttcttaatcctgagttctaatttgattgcactgtggtctgagagactgtttgttatgatttccattcttttgtatttgctgaggagtgttttacttcgaattatgtaatcagttttagaataagtgtaatgtggtgctgagaagaatgtataatctgttgatttggggtggagagttctgtagatctctattaggtctgcttggtccagagctgagttcaagtcctgaatatccttgttaattttctgtctcattaatctaatattgacagtggggtgttaaagtatcccactattattgtgtgggagtctacgtctctttgtatgtctctaagaacttgctttatgaatctgggtgctcctgtattgggtgcatatgtatttaggatagttagctcttcttgctgcatttttccctttaccattatgtgatgctcttctttgtctcttttggtctttgttggtttaaagtctgttttatcagagattaggattgcaactcttgcttttttttttgctttccatttgcttggtaaatattcctccatccctttattttgagcctatgtgtgtctttgcaagtgagatgagtctcctgaatacagcatactgatgggtcttgactctttatccaatttgccagtctgtgtcttttaattggggtatttagcccatttacatttaaggttaatattgttatgtgtgaatttgatcctgtcattatgatgctagctggttgttttgcccattagttaatgcagtttcttcatagtgtcaatgttctttacaatttggtatgtttttgcagtggctagtaccagttgttcctttccatgtttagtgcttctttcaggagctcttgtaaggcaggtctgatggtgacaaaatccctcagcattcggttgtctgtaaagaatttcatttctccttcacttatgaagctttaagaggtttaattgactcacagttctgcatggctgtcccataagtcccatgttctttcctcaggaaacctacagtcatagcagaaagggaaataggcacatcttacatggcagcaggcaagagagagtgtgtgaaggaggaactgtcaaacacttataaaaccatcagctctcataagaactcactatcaggagaacagcgtgggggaaaccatccccatgatccaatcacctcccactaggtccctcccttgacatgtgggcattatggggattacgattcaaggtgagatttgagtgggaacatagagccaaaccatatcagtatctaaaaggaaaaaccttcagtttttccacatttggttatgatatcagctgtgagcttttcctatatggtctttattgtgttaagttccttctgtatctatcttgctgaaagtttttattatgaatggatatctagttttgtcaaattctttttctgtattgatcgaaataatcatgtgtttttcatctttcattctgataatgtggtatatcacattgattgatttgcccatgttgaaccatccttgcatcctagggataaataccacttgttcatgatgaatgatccttttaatgtgctgttgaatttggttggctggtgttttgttgaggatttttgtatccgtgttcatcagggatattggcctgtagttttctttcttttcttttcattttctttttctttctttttttttttttttttttttgagacagagtcttgctctgtcacccaggctggagtgcagtggtggtatgatcttggctcactacaacctccacctcctggattcaagcgattctcctgcctcagcctcctgagtagctgggactactggaacatgccatcacacccagctaatttttgtatttttttagtagagatgagttttcaccttgttggccaggctggtctcgaattcctgacctcaagtgatttgcctgcttcagcctcccaaagtgttgggattacaggcttgagccaccacacctggcctggcctgtagttttcttttctagtgttgtttttgcctggatatggtatcagggtgatgttggctaataaattgtattttgaagtgttctctcttgtattttttggaagagtttaagaaatactggtattaatacttcgttgaatgtttgatggaattcatccatgaagccattggtcctgggcttttctttgttggaaggtttttgattactagatttaatatccctatttgttgttagtctgttaaggctttctatttctttgttattcagttttggtatgttatatgtttctaggaatttatccatttcctctaggttaaccaatttgttgacacttataatagtcccttatggttctgtctgtttctgtgacatcagttgtagtgtctcctctttcatttatattttatttatatgagtcttctctctttttttcgtagtctagataaggacttgtcaattttgtttattttttcaaaaaaatcaactcttagttttgtcagttatttccaattgtttttttattctcttttttatttatttctgctctagcatttattatctcctttgttctgctacctttgggcttagttttttttttcttctttttgtagttcctggaggtgataagttgggttgtttatttcatatgtttcttctttttaaatataggcatttattgctataaatttccctattagtatgcttttactgcatcctttaagttttggtatattatcaagattttggtttcttctgtgacccaatggtcgttcaagaatgtgttgtttagtttccacatatttgtgaattttcgtgttttcttattgttattgatttgtagtttcaatccattgtggtcagaaaatatacttggtatgatattaatcttcttaaatttattatgacttgttttgtgacctgaaaggtgatctgtcctgaagaatgttttgtgtgtgcttgataattctactgttgggtggaaagttctgtatatacattttaggtccattgggtctattttattcttcagttctgttttgtccttattgattttctgttgggatgatctattcattatagagagtggagtattgaagtcaactatattatattgttatctatttctccttccatgtctgtcaatgtttgctttatatatttaggtactttcgtgttgggtacatatatatttataattattacatcttcctgttcaagtgacccttttattatataatgaccttctatgtctcatgtcacagttttttacttaaagactattttttctcatacaagtatagccacccctgctctcttttggttacagtttgcatggcataactttctccaccccttcactttcagcctatgtatgtccttaaatcaaaagtgagtctgttatcaacaacatgtagttgggtcctgtttatttttgtttcttacttcccatctctgaattgttggctttttaaaaagcccattcagttactctgtgtcttttgactggggagtttagtcaatttacacttaaagtaattattgataggttaggactttctgttgccattctgttaatagttttctgttttgtagttttcttgttcctttcctctttttctttctttgtggtttgatgatttttgcttggatgtgttttgattcttttctctttatcttctgtatatctactgtgtgggggggcggtcgggggggttaccacagggatcaaattgaacactttatagttatggcagtctgttttaagctgacaacaccttcaatcacatacagaaactctatactttactcattccccccgccacaactttatgtaatcgacgtcatattttacttccttctatattgtgtttccattgacaaatttctgtcactatagttactattactatttttgtcttttaatttataaattaatattaatagtgatttataacaatcattatagtgttacaatagtctatgtttctctttatatttacctttagcagtgaaaggattcatatgcttttgtgttactgttttttttttatttcaacttgaagaactattagcacttcttataaggcaggtctcatggtgacaaaccccctcagtttttgtttgagaaaggctttatctttgtgttcattcttaaaggacagtttttccagataaagtattgttgattggatttttttctctcagtactttgaatatatcatcccactctttcctgacctgcaaggtttctgctgagatatccactcatagtcttatggagctcccctataggtgacaattcactttcttcttactaccccaaaattctcttttgtctttgttgaaaatttaattataatgcatctcactgtagacttctgtgggtttaatgtatttggttatctttgggcttaatgaatccagatggcacttcccctccatagatttggggagttctcacctattatttctttaaataagtttcctttctctctctcttctccttttaagatttctataatgcatctatcattttgcttgatgatgtcccataagtcctctgttcttccttcactctttctcattgttctttttattccgctaactagataatttcaaatgacttgtcttcaagtttacaaattctttcttctgaatgattgagtctgctattaaagatcgctattaaattttttagttcagtcattcttcagctatattcagcaatattctttagctacaggatttttatttggttcttttttatggtttttatttctttattaaacttctaatgttgttcatgtattgttttcctcattttgttagtcgtcttcctgtatcctcttgtagctaattgagcttctttaaatgattattttgaattctttgtcaaaaatttcatgaatctccatttcttcagggttggttactggagctttattagttccctttggtgatgtcatatttgcctgattcttcatgatccacatagcctagcattggtatctgtgcattggagtgagctgacacctcttctggtctgaagttgggtactcagacaatgggcccattaccagggctttggataggtgtagctctcactgggtccttgagtgggcaggactgcctgcagaccatgatgcagtgggcctggagctgggtcaaagggctgcttcagggtccccacttgggcccacagtcagtgggcctgttatgggggcacaggtaagtgtggattcaggcaggactgtctccagaacatggtacagcaagactggagttggctcacagggttacttctgagtccacagtcaggtctagttggtgggcctgcttccagaggtggactggcatgactcccacctgtttcctaagtaggcaaaacttccccaagaccatggtagtgtggtactgaagctgctttaggtacagggctgcttcagagtccacagttgggagccctgttactggggttgccaatgggagttgctcctcccagattcctgggcagatagggatagtggtaggaccacatacaaacaactctggagctaagtccccagggtggtgggctgcttctgggtccacaaccagaactacagttgacaggcctgccgctagaatgtgggcctgccttattaaagtattcatctttgttcttgagctctaccagggtttctcaacctcctacctgaatcccaaggctcccacaaagacacttttgtccatagatcattgtcaaattattgttcctgtgggggaacaagagctagggacctcctatcccatcaactcactgataccgttctcctgatgctgcattttgaattgccctcaggtgatgctgctactcctggtctgtggaccatgctggagtagcagagcccaaatggcttcctcaacttttatgagccttttacaggaactcaaagtagaaaataacttcacttgccccagacctaataatttcctttgttcccacttcttcttggtgctttcctcctttgtgtctaccatcgtaacatccatctaaccatagttgtcttatgtagatgttggatgctgttgagaaacgcacaaagcaaattagaaggaagatatgattgacagaaattgctttttactctgtattcactttccatgtatttgtgctaatctctccatacaggtcttctttggcaatgtggattcatctgggataaaacacaatatttttaaccctccaattattgctcgatacatccgtttgcacccaactcattatagcattcgcagcactcttcgcatggagttgatgggctgtgatttaaatagtaagtgccaagtcatcccatatccttcttccctcaaccatgggtagggtgactaactgttctagttatcctgagactgggggaggggttcccggtatcaggacacaaaattgtcagtgctaaaaccagcatagtcctgggcaaacccagaaataccattcaacccagcagtcccatcactgggtatataatcaaaggaatataaatcattctgtcataaagacacatgcacgcatatgttcatttcagcactattcacaatagcaaaggcatggagtcaacctaaatgcccatcaacaacagattggataaagaaaatgtggtacatacataccatggaatactatgcagccataaaaaagaatgagatcatgtccttttcagcaacatagatgcagctagaggccattatcataaatgaactaatgcaggaacagaaaaccaaatatcatgtgttctcataagtgggagctaaacattaaatgcacatggacacaatgatggacactcaggaggggagaggttgggaggggggtgtgggttagaaggttatgtattgtgtactgcactcactacctgagtgaggggatcattcatacaccaagcctcagtgacatgcaatttacccatgcaacaaacctacccatgtacccctagaatctaaaataaaagtagaagaagaaaagaaacaaagaaaattaaagagtcacacaaagtgggaagagctggctggaaaacagatagcaataacagaattggccgggcgtggtggctcacacctgtaatcccagcactttgtgaggccaaggcgggtggatcacgaggtcaggagatcaagaccatcctggctaacatagtgaaaccccaactctactaaaaatacaaaaaattagccgggtgtggtggtgtgcgcctgtagtcccagctactcgggaggctgaggcaagagaatcgcttgaactcgggaggcagaggttgcagtgagctgagatcatgccactacactccagcctgggtgacaaagcgagactccatctcaaaaaaacaaaaacaaaacaaaacaaaacaaaaaaccaataacagaatctgtgcaaaagttaaaacctgagaaatgatattatgatgacagtagccctagaatatcagtggaagctgctcagtataactgaggctgaagcatgtccttgtgataaccttcttttttcttttctttgaggttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtaagaggcaacagatttactgtttaactgactcagagcagtggttggggaaaaaatcggggaaggccttgactgtttcttctgaggtatttctgtcaactgttagttctaaaaagtgtgtcaaggaagtttggttatgggcagacaaccacacaggcatttgggggaaatgatctctaattgaacctcctggaagaagaatctctatatctagtactgagctaatatctgtcaaagaattgtagaagctaaagtccattttacagataaatatcaacaattagctttctttccaggtttctcattacatcaatgaaaagtaaacatttactgcacatcttagtatccctaggatgagcctagggatacaaaggtgaattgtgaaaaattttggccctgaagttgcttagagttgaataagagagactgactagccaatagaaagtggaggctgggtgcggtggctcatgcctgtaatcccagcactttgggaggctgaggcgggccgatcacaaggtcaggagttctagatcactcttttgctgaggcaggataatcgcatgaacctgggaggcggaggttgcagtgagctgagatcatgctattgcactccagcccaggcaacagtgcctgactctgtctgaaagaggcagagagagagagagagagaaagaaaggaaagaaggaaggaagaaaaagaaagaaaggaaggaaggaaggaggccgggcagagtggctcacgcctgtaatcctagcactttgggaggcctaggtggcagatcacctgaagtcaggagttcaagaccagcctggccaacctggtgaaacctcatctctactaaaaatataaaattatctggacatggtggtgggcacctgtaaccacagctactcgggaagctgaggcaggagaatcggttgaactcgggaggcagaggttcagtgagctgagatcatgccattgcactacagcctgggtgacagagcaagactccgtctcaaaaaagaaagtagagtgagaagtgctgtggtatggttaagagggatttgggaatttctgggagtaaatggtgaccaagaggctactagtccaactctattgccctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtaagctggtctccttggaaagaaagaaagaaagaaaaaaaataccacctctcctagagcttaacataacataaaaaggttgatatatgaccaaattttcagagcaaaatttattaagtacctatggtagcaagacattgtaaaaggcattctgagagaacacagtgactttaagaaaaaggtaaaatactgagaaaagggcagagtagatccaagagttaattctcctcatcagcaccttgattcccaagcctttttgacctttaagtttagtggtccaggaagtcttcattcttaatctgggtttgctggataattcaacaaattgtcctgattaaaagacatgacataaagtcttatcaccccatgagtaatgggggaaggaatagttcctctctttggtattttttatattcttttttcaccaagaattaaccatgatgtggtccttaccaatctctctaatacagtctcttgccacttggctctttaagctccatccatactaagaaattctcaggtcactaaatacagccattatatctcataccaggcttttaaatagatactatttcttctacctggaacatttttctagctaccctctactgccactttcacctgactcattcgttaagtctcaggtaaacatcatgtccaagaagaattcccttatccatcaaggctggatgaaagacttcaccaaactggcagtttggtgaactgaagtctagacattggatattctagaagaaaaattcccatttaaaaaaggttatatctctgattagtgccacaacatgatgaactttcaaaatatgctaagtgaaggccgggcgcggtggctgatgcctgtaatcccagcactttgggaggctgaggcaggcagatcacgaggtcggtaaattgagaccatcctggctaacacagtgaaaccccatctctactaaaaatacaaaaaattagccaagcgtggtggcgggtgcctgtagtcccagctactcgggaggctgagacaggagaatggcatgaacccgggaggcagagcttgcagtgagccgagatcgcaccactgcattccaacctgggcaacagagtgagactccatctcaaaaaaaaaaaaaaaagaaaatacgctaagtgaataggccagacataaaaggatagatattatatgattctacttatatgagtgtgttagtcagggatatccaaagaaatagaaccaataggagattctgtctgtctgtctctctctctctgtctctctggatgagctaaactgttttagttcaagactgaaagcaggaaaaagctgatgttccagtccaaaggcagacaggcagcaagaatactttcttacttggggaagactcagtctttttgttctattcaggccttcaactaattggatgatgcctcccacattagggagagcaatctgctttactcagtctactgacttcgatgttaatcccattcaaaaacaccttcacagaaataaccagaataatgtttgagtaaatatctgggcaccttatgaccaagtaaagtagatacataaaattaaccatgacaagtccaccccttgtcaatgtagcacccatcatacacatctcctttatctctaagtagagacaaaaatgaggtcataattccacctaacatgatataacaaaacttggctggtattgataactaccttcttctactacccattctgtattgactttgccttcagcaagcatctcagctgattgtggttctttacctgatgaggtgacccaaacctttattcctgaagagcctgggccactagtagtcctgcatggattgggttgctgtagtttcccattgaccagaatcatagggcctggtaatactaagagacactctaagggatctattgtattccagacacactcttccatacctccattgtgaagcagtagttcagtttccttccaggaaggacaaaacgctgccccttccatgatgaacatattccaatgtaatcaacctgctgccagatagctggctgatcatcctgggaaatactgccatactgaggactctgtgtttgtctctactgctggcagattgggcacttagcagtggccatagccaggtcagccttgttgaatagaagtccatgttgctgagcccatgcatagcctctatccctgccaccatggctactttgttcatgagcccatcaggcagtgacataggtggctgagtaaaaaggatgactggtatccacagaacaggtcatcatatctactttttttttgagatggagtcttgctctgttgcccaggctggagtgcagtggcacaatctcagctcactgcaacctctgcctcccaggttcaagcatttctcgtgcctcagcctcccgagtagctgggactacaggcacgcatcaccatgcctggctaatttttgtatttttagtagagacagggtttcaccatgttggccaggctggtcttgaactcctgacttcaggtgatcctcccgccttggcttcccaaagtgctgggattacaggcgtgagccactgcacccggcccatcatatttacttgattattgaaatccttatctgctgaggtcacccttcgttgagcactcacatgggacataaatatattcacatcctttgcccattcagagagatctgtccacatacctcttccccaaatttctttgtcacctgttttctaatcatgttccttccaagtccctatctggacaaagcactgactacagcccattacttgacatataattgcacacctggccatttctccttctaagcaaagtccacaaccaggtacactgcctaaaattctgcccactgtccttcatgggtatctcagatcgggactgtccacttttgtgtagtacctgcatatcgtgcagaaccgtctgtaaaccaggcccaagactcctcttcctctgtaaactgatcatagggaactcccaatggggccataagtgcaggctgggagagagaaggcagggtagcagaaacaggcaccatggacatttgggctacttcttcatgtaatttacatgtgttttcagtacctgctcagacatgatcatgtatataccacttccatttgatgatggagtgccattgttcatacccaactttatggcttggtgggtcagataacacctagttcatgatgggcagttcaggtcacatggcaacttggtggtctgtggctaagcattcagtatctactaaggcccagtagtaggccaagagctatctcacaaaaggagaacagttattcacagaggattacaggaggatttctcactacagtagcccctgctccataggtcagggaaccaatgtgaagatcctgctagctgctcaatatatctgttccaattacgcattccaggactggggaaataaccacaagatagtctcacagatcctctgcatccactttgagatggacttgagctaaaattccattgatcatttgaccctccataagcccatactctgactggtggaccacagtgacattttgggtctcctgaaattagtgccagttcagagccattgtccagtagtccctgaaaggtctgattaattatttttcttcagtgcacatttattctgatagaaaggccatatgtccctttggggaaggctgagagaaagagtggcagtattcttggcagtgtaccagagtccttcctcaaggagactgagcctccccttcattcaaggagtgctgggtctgtaaacctgctcaagtctgggaattgattgagaggccgtgactctgtttttattattcaggttagacttttgttcacttgacctagaacttttccacttatgcagttcaagaatttggtaggcattctatctatatcacatctaggaacactataatctactagccaacaccataggtctgtgcaagtcatactattctaactgctgctttgactctgctgtcccttatggtaaccacacttaccttgcctttggcagttgagtgctgcccattggccccttccaccccaggatccaattattcccattgtatttaggttttctaattcagtgactgcaggtcctgctgtaaggtgtcacctacagagaagagtgatcacagagcccttcaaggatgctgaggttcccctcacaaatttattcctcaaagtaatagtgagatctgtgtcttctgaactctcccagtgttggtgagtatgtcttaaatgacaaattcactctagcatttcaatctcctttcttctacattaaaccagggcaagtctgaaatttctagtttgctcactgtgggccatcttttggtctgtgtttcagccaaccaattaaactgttagaggccttcctaattccctgagatgcaacattaagtccagaatctctgcttagtgggcccatgtcaataaatttggcctaatccaactttacgtgccttccaccgttatctcacatccttagtacccattcctatacatattctctggattcctgcttgtgtaaattagaaaactcaagtcatgattttggagtgtagtgcaccttgtcatgggtcaccttcatacctcacctcgcctgctgggacttgagtgtagttatagatctaataacaaagaggggtggtagggtgggtcctgaaggaatcagcattatcttgcatggcagttgcctcaggggaagccattacagtttcctcaggcagtgcagggttaatccacttagactggagtagagatactgccaccacagggctggagagaaaactttcactgacaaagaagactcatcaatatttaggagctcaatgtccccagcttaatcagggtcttccacacatacctaatccaacttgtagtgccccattctttcccaatcactgcccttgctttaacagtagacaccctgcaaagctgggagtttggcttgctttgtaattcagttagtcacaggatgagatttggcatttgattttcagcaatctcagctctgtggctacagtagataagggtctccttcagggcatacatagaatctgtcaagtcatttatgcagctcttgagctgggaattcaaattcctgagctcctccttttctttcatcactttttccagcaacattaggagcaaccgactaatcccatcatattcattagtttgacaaatatgttcacaagtgtcaatatacatagtcaccaagacccttgcttcttaaaagtagttgattaggagtatccaatggagatattttgcatatacatattttttgagatggagtctcgctctgtcacccaggccggagtgcagtggcatgatctcagctcactgcaacctccatctcccaggttcaagcgattatcatgcctcagcctcccgagtagttgggattacaggcacctgcctaatttttgtgtttttagtagagacagggtttcatcatgttggccaggctggtctcgaactcctgacctcaggtgatccatccacctcggcctcccaaagtgctgggattacaggcgtgagccaccgcgcccagcctggcctacatatttctattgccagatcatgccatggacaatttttactactgaaaatagtcattagtgtctttaaatttcatcaggttacagaaccaattccagaaatccaataacaaatttataaaatttatccttaaaattctgttcctttagaatcactcttggtgtgaaaatctgtattagtcatggttcccaaagaaacaaaaccagaaccaagaggagatacatacacacacacacacacacacacacacacaaggaattagctcatgtgattatggagtctgccaagtctcaagatctgcagggtgagttggcagcctagagaccccagagagctgattcgtagttccagttcaaagaccagcaggctacagacccagaaagagttaaaatgttttagttcgagcccaaaggcaggaaaaaaactgaagtcccagtttaaaggtagtcaaatagaaggaactgtctcttactaagaggacagtaagcctttttgttatatttaggccttcaactgattggataagttctacccacactggggagaacaatctgctttacttagtctaccaattcaaatgttaatctcaccaaaaaacactctcacagacacacataaaataaagtttaatcaaatatatgggcaccccatggcccagtcaagttgacacataaaattaaccaccataatgaggtatctagagcaggcaaattcataaagacagaaagtagaaaagaggttaccagggtcttggaatggggaagaaatggagagttatttttaatgagtacagagtttctgtttggggtgatgaaaaagttctggaaatggatagtggtaatgggtgcacaatattgtgagtatacttaataccactaaattgtacacttaaaaatgattaaaatggtaaattttatgtatattgtacaacaataaaaaaggctatatcactgacaatgcattgttgtatttagcaaagaaaggggaatctccagcctccccatcaacaaaaacccccacaaacttctattttaaaataatgagctgaaatcatagcggagaggtgaataatgagcaaatataaaaaggaagacctttcctcagacagaatgcccatattaatgttgttactggaagactaagccttgagcaaaatgcaaggagaactcagtgtgagaattctgcattgtcatgaatcccagaaggaagctagagaagttgcagataaatattatcctctggcacctggaagaaccattctcaacctactctagaaaaaaagcacctccagtttaggcctccaggattcctacatattaaaattataagatcacagacatagatcagcaaacatgcaagacaacaagacaacttgagtacaagtgaacagaaacaatcaattcagatttaaaacttgaagaacaccagatattgacattatcggatacataatatgaaataattatgtataaaatctttaaagtaataacatatggaaacatgaaaataaaagacaaattatccaacattattaggcagttgaaaaaaaccattgcaggttacaaagtcaacatgcaaaaatcaattgtatttttatatactaacaattacaaatatgaaaaggaaaacagaaaagtctatttacaatagcatcaaagataatacaatatttaggaataaatttaacgaaggaggtgcaagtcttgtccactaaaaacaaaaaaacccagttgaaagaaactaaagaactgtctggtctgaagacagcaaatatggaaaattagcaactagaaaaaaattaaaaattaaaaattaaaagagaaattaaataactaaataaatgaaaaggcatcctggatttatggatttgaagacataatattcttaagataagaatattaccacaaaccatttgcagattcaaagcaagcattctgggtttttttgtttgtttgtttgttttttgatttgagacggagtctcactctgtcgctcaggctgcagtgtggtggtgcaatctccactcaccataacctctgcttcctgggctcaagcgattctccggcctcaaagcattctctatcagaatcccaaagacatttttttttttgaggaatagaaaaatctatcctaaaattcagatggaatttcaagggaccctgaatagccaaaacaatcttgaaaaagaacaacgttggaggagtcatacttcccaatttcagaacttactacaaagctacaagaatcaaaacagggcagtacttacataaatatagacacatagatcaatggaatagaattgagagtccagaaataagcctatacatctatggtcaattgattttcaataaaagtgccaagaccattttgtgggaaaagaatagtctcttcaacaaatggtgctgggacaattggatatccacatgcaaaagaatgaagttggatctttaccatatacaaaatttaactcaaggctggatgtggtggctcacatctgtaatcccagcactttgggaggctaaggctggtggatcacttgagctcaggagtttgagaccagcctgggcaacacagtgagactctgtatctacaaaacaagaaaaaaaaattagctggcatgatggtacacacctgtagtcccagctactagggaagctgggataggaggatcgcttgagcccaggaggtggaggctgcagtgagccatgatcgcaccactgcactccagcctgggtgtcagagcaagaccctgtctgtaaaaaatcatttaactaaaaatgtatcaaaaaactaaatataaaagctaaaaccataaaactgtaagaaaaaacaaagaggtaaattgttatgatactggatttggcaatggtttcttagatgtgacaccacaatcacaagcaacaactctataaaaatatatatagtaggcatctttaaagttaaaagcttttgtacatcaaagaacactatcaagaaagtaaaaagatgatctacagtataggagaaaaaaattgcaaatcatatatctgataaagggcctagtatcccagaatataaaaagaactcttacaactcaacaacagaaagacaaccaaattttaaaatgggtaaaggacttcaatggaacttctccaaagaagatatacaaggatccaacaaactcatgaaaagatagacaacatcattagttattagggaaatgcaaatcaaaaccacaatgagatagcatttcaaacctgctaggatggctaaattaaaaaaaaaacaaaaacaaaatgtcaagcgggaaaataacaagtgttagcaagaatataaagaaattggaaccttccttgatgatgagaatgtgaaatagggcagccactgtagaaaatattttggcagttcctcagtaaggaaaacatagaattaacatagacccagcaattctactcctgggtgtggacccaaaagaattaaaagcaggcactctaacaaaaactaatatacaaatgcatatagaagtactattcataatagcaaacaggtgaaaacaattcaaatgttcatcaagtgatgaacagataaacaaaatgtggtctatccatatatggactattatttattcataaaaaatcaaagtactgatccatgctaaaacatggatgctccttgaaagcattatgctaagtgaaagcagccaggcacaaaaggccacattccacttatatgaaatacccagaatagcaaatccatagagacagaaaacagattagtggttgccagaagctggcagaaggagtgaatgtggagtggcttcttaataagtattgaatctccttttggggttatagaaatgttctggaactagatagtggtgatggctatataacattgtgaatgtactaaatggcactgaacttcacactttaaaattgttaaaatggtaaattttatgtttgcgaattttgcaatagataagtcagaagacatgtacattaccataatgagtaacaaactgacagctgatttctaaataatagcaaatatcagaaaataatgaatgatgtcttcacaatgctaaaataaacaatgtgaacccctctctcaaaaagaaaacctaatgaaaatatcttttatgcgttaaagcaaaagaggaaattaggacacagacaggcacagagggacgaccacatgaagatatagaaagaggacagacacctacaagccaacgagagaggccttacaagaaaccaacccttagccaggtgtggtagtgtgcacttgtagttcttgttacaagggtgcagtgagctagggttgtgccactgcactccagcctgggaaacagaacaagaccctgcctctaaaaaaaaaaataaagagaaggagaagaagaagaaaaggaaaagaaaaaaaaaaagaaccaagcctgctggccaggcgtggtaactcatgcctgtaatcccagcactttggaaggctgaggcaggaagatcatctgaggtcaggagttcaagaccagcctgcccaacatggtgaaacccccctctactaaaaatacaaaaattagctggacatgctggcatgcgcttgtaatcccagctactcgggaggctgaggcacaagaattgcttgagcccaggaggcagaagttgcagtgagcccagatcgcgccatcacattccagcctggactacagagggagactccatctcaaaaaacaaacagacaaaaaaaaaatacacacacacacacacacacacacacacacacacacaaaacaagcctgcctaccccttgatcttggacttgtagcctccagaactgtgagaaaataaatttctattgtttaagccaggtgtgcgtgtgaaaatttagaacatatgacaacagcaaaaaagtcagcatgtggataaatagaataaaggattctaaaatccatgtattatctaggaggtaaagatgttaatattaaaccttcataatttgattaatgttgtagtttataggatagccagtaagtaatagaaatacacacaatgtaagactcccaaaatggtagaagaaaaaatatgaaaggataaaatatactcaacaaacctaaatgaaagcaagcaaagagagataaagaaacataaaacaggtaggaaaaatagcaagataagatggtatatttaaattgaaatataacagtaatcatatgtaatatgaatggaccaaatatttcagttaaaagacaaagattgtcagattgataaaaaagcaaaagtagctgggtgtgatggctcacacctgtagtcccagctacttaggatgctgatgtgggaggatcacttgagcccaggaggttcagcctggacaagatagtgagacttgtctctttaaaaaaaaaaaaaaaaagcaaaagtaaattgtgtgcattttatgagtcatatctaaaacattagatacagaaaagtagcaagacaaaaatgggaaaagaaattatgcaaatatctaaaagatatcgattacagctctattgatagcagaaaaatagactttaaagcaagaaagtattgctgaagattaagaatgtgatttcatggctggacgcggtggctcacacctgtaatcccagcactttgggaggccgaggcaggtggatcatgaggtcaggaaattgagaccatcctggctaacatggtgaaaccccgtctctactaaaaaaaaatacaaaaattagccgggtgtggtggcggacacctgtagtcccagttactcaggagggtgaggcaggagaatggcgtgaactcgggaggctagattttaacacatctctcgtcaattgatggaacaatgtatagaaatagaacaattaacatgattcacaagtttgatcttatagacatatttagaaaatagcaccttgaaattgcaaaattacaagggtggttccaacatggccgaataggaacagctccagtctacagctcccagcatgaatgacacagaagacaggtgatttctgcatttccaactaaggtaccaggttaatctcactgtggcttgtcggacagtgggtgcaggacagtgggtgcagcccaccgagcatgagccgaagcagggtaaggtatcacctcacccgggaagcacaaggggtcagggaattccctttcctagccaagggaagctgtgacagatggcacctggaaaattgggtcactcccatcctaatactgcgcttttccaatggtcttagcaaacggcacaccaggagattatatcctgcacctggctcagagggtcccacacccacggagcctcgctcattgctagcacagcagtctgagatcaaactgcaaggtggctgcaaggcagggagaggggcacccgccattgctgaggcttgagtaggtaaacaaagcggccaggaagctcgaacttggtggagcccaccgcagctcaaggaggcctgcctgcctctgtacgctccacctttgggggcagggcaaagacaaacaaaaagacagcagtaacctctgcagacttaaatgtccctgtctgacagctttgaagagagtagtggttctcccagcacagagtttgtgatctgagaacggacagactgcctcctcaagtgggtccctgacccccgagtagcctaactgggaggcacgccccagtaggggcagactgacacctcacacagctgggtacccctctgagaccaagcttccagaggaacgatcaggcagcaacatttgctgttcagcaatattcgctcttctgcagcctctgctgctgatacccaggcaaacagggtctggagcggacctccagcaaactccaacagacctgcagctgagggtcctgtctgttagaaggaaaactaacaaacagaaaggacatccacaccaaaaccccatctgtacatcaccatcatcaaagaccaaaggtagataaaaccacaaagatggggaaaaaacagagcagaaaagctgaaaattctaaaaatcagagtacctctcctactccaaaggaacgcagctcctcgccagcaacggaacaaagctggacagaaaatgactttgacgagttgagagaagaaggcttcagatgatcaaacttctctgagctaaaggaggaagttcgaacccatcacaaagaagctaaaaaccttgaaaaaaaaggttagatgaatggctaactagaataaccagtatagagaagtccttaaatgacctgatggagctgaaaaccatggcacgagaactatgtgacgaatgcataagctttagtagccgatgcgatcaactggaagaaagggtatcagtgattgaagatcaaatgaatgaaatgaagcgagaagagaagtttagagaaaaaagaataaaaagaaatgaacaaagcctccaagaaatatgggactatgtgaaaagaccaaatctatgtctgattagtgtacctgaaagtgacagggagaatggaaccaagttggaaaacactctgcaggatattatccaggagaacttccccaacctagcaaggcaggccaacattcaaattcaggaaatacagagaacgccacaaagatactccttgagaagagcaactccaagacacataactgtcagattcaccaaagttgaaatgaaggaaaaaatgttaagggcagccagacagaaagttcgggttacccgcaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcttgccctacaagagctcctgaaggaagcactaaacatagaaaggaacaaccggtaccagccactgcaaaaacatcccaaattgtaaagaccatcgatgctaggaagaaactgcatcaactaatgagcaaaataaccagctaacatcataatgacaggatcaaattcacacataacaatattaaccttaaacataaatgggctaactgctccaattaaaagacacagactggcacattggataaagagtcaagacccatcagtgtgctgtattcaggagacccatctcacatgcagagactcacataggctcgaaataaagggatggaggaagatctaccaagcaaatggaaaacaaaaaaagaaaagcaggggttgcaatcctagtctctgataaaacagactttaaaccaacaaagatcaaaagagacaaggccattacataatggtaaagggatcaattcaacaagaagagctaactatccaaaatatatatgcacccaatacaggagcacccagattcataaagcaagtccttagagacctacaaagagacttagactcccacacaataataatgggagactttaacaccccactgtcaacattagacagttcaacgagacagaaagttaacaaggatatccaggaattgaactcagctctgcagcaagcggacctaatagacatctacagaactctccatcccaaatcaacagaatatacattcttctcagcaccacatccaaaactgaccacatagttggaagtaaagcactcctcagcaaatgtaaaagaacagaaattataacaaactgtctctcaggccacagtgcaatcaaactagaactcaggattaagaaactcattcaaaaccgctcaactacatggaaactgaacaacctgctcctgaatgactactgggtacatagcgaaatgaaggcagaaataaagatgttctttgaaaccaatgagaacaaagacacaatataccagaatctctgggacacatttaaagcagtgtgtagaggaaaatttatagcactaagtgcccacaggagaaagcaggaaagatcaaaaattgacaccctaacatcacaatttaaagaactagagaagcaagagcaaacacattcaaaagctggcagaaggcaagaaataactaagatcagagcagaactgaaggagatagagacacaaaaaaccctttaaaaaatcaatgaatccaggaactggttttttgaaaagatcaacaaaattgatagaacactagcaagactaataaagaagaaaagagagaagaatcaaatagacgcaataaaaaatgataaaggggatatcaccaccaatcccacagaaatacaaactaccatcagagaatactataaacacctctatgtaaataaactagaaaatctagaagaaatggataaattcctggacacatacaccctcccaagactaaaccaggaagaagttgaatccctgaatagaccaataacaggctctgaaattgaggcaataattaatagcttaccaaccaaaaaaagtccaggaccagacggattcacactcaaattctaccagaactacaaggaggagctggtaccattccttctgaaactattccaatcaatagaaaaagatggaatcctccctaactcattttatgaggccagcatcatcctgataccaaagcctggcagagaaacaacaaaaaaagagaattttagaccaatatccctgatgaacattgatgcaaaaatcctcaataaaatactggcaaaccaaatccagcagcacatcaaaaagcttatccaccatgatcaagtgggcttcatctctgggatgcaaggctggttcaacatacgaaaatcaataaacgtaatccagcatataaacagaaccaaagacaaaaaccacatgattatctcaatagatgcagaaaaggcctttgacaaaattcaacaacacttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgttcgcagacgacatgattgtatatctagaaaacaccattgtctcagcccaaaatctccttatgctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatatgaaggacctcttcaaggagaactacaaaccactgctcaatgaaataaaaggggatacaaacaaatggaagaacattccatgctcatgggtaggaagaatcaatattgtgaaaatggccatactgcccaaggtattttatagattcaatgccatccccatcatgctaccaatgactttctttacagaattctaaaaaactattttaaagttcatttggaaccaaaaaagagcccgcattgccaagtcaatcctaagccaaaagaacaaagctggaggcatcacgctacctgacttcaaactatactacacggctacagtaaccaaaacagcatggtactggtaccaaaacagagatatagaccaatggaacagaacagagccctcagaagtaataccacacatctacaaccatctgatctttgacaaacctgacaaaaacaagaaatggggaaaggattccctattgaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattgacaaatgggatctaatgaaactaaagagcttccgcacagcaaaagaaactaccatcccagtgaacaggcgagctacaaattgggagaaaatgtttgcaatctattcatctgacaaagggctaatatccagaatctacgaagaactcaaacaaacttacaagaaaaaaagaccccatcaaaaagtgggtgaaggatataaacagacacttctcaaaagaagacatttatgcagccaacagatacatgaaaaaatgctcatcatcactggccatcagagaaatgcaaatcaaaaccacagtgagataccatctcacaccagttagaatggcgatcattaaaaagtcaggaaacaacaggtgctggagaggatgtggagaaataggaacgcttttacactgttggtgggactgtaaactagttcaacaattgtggaagacagtgtggcgattcctcaaggatctagaactagaaataccatttgacccagccatcccattactgggtatgtacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaggatctgttcatgtcctttgtagggacatggatgaagctggaaaccatcattctcaaaaactatcacaaggacaaaaaaccaaacaccgcatgttctcactcgtaggtgggaattgaacaataagaacacttggacacaggtaggggaacatcacacaccggggcctgtcatggggtgggtggacaggggagggatagcattaggagatatacctaatgtaaatgacgagttaatgggtgcagcacaccaacatggcacatgtatacatatgtaacaaacctgcacgttgtgcacatgtaccctagaacttacagtataataaaaaaaaagaaattgcaaaattacacattctttgtaagcacacaaaggaaacatgttagaattttccattttaagctacaaataagctacaaataaagtagtctcaaatttcagataatataaaacatgttttctggtcacaatacaattaaagttgatataaataagaaagataactataaaatcttcctatgttagaatcaagaactatacttttaaacccatgtgtcaaataagaaatcataaattagaaaatattttaaactgaatgataacaaggcatgacatattaaaatgtgggaatcagctaaagcaatatttagaaagaaatgtatagcgttaaaaacatatattggaagagaagaaagcctgacaattaatgagctaaggtatgtctcaagaagctagtgaaacagcaaaataaaccaaaaggaagtagaagcaaggaaataataaagatatgaagtaaatgaagtaaaaaagaaacatacaatagagagaataaagaaaaccaaaagttggttccttgaaaattgacaaacttctggcaagagcaatcaagatgaaaagaaggcacaaataatatcagaaactttaaaaaactggacatcaataaagatcccacaaaaatttctgccaatataaaaatataaaaaatgaggatacttattaatattaaatgttctttcttgttgtatttaccagggattaatccattttacctaattttccaaacttagtgttaaaaggttattaatttaaaaaatccagatccagatggctacactaactatattctaccaatttttcaaaggagaaataatattaaccttgcaaaaattctttcagaaaatggaaaaagatggaatgttattcaattatcttatgataatagcataaccttgacaaccaaaccgaacaagaacaatattagaaaggaagataataggcccgttttattcataaacataaatcccaaacaaaatattagcaatatggatccaaattggatttatgctaggaatgcaagtttggcttatacattagaaaactgatataatttatcacagtgacagactgaaggattatacatattggctgtcctaagcagtgcaataagatgagaaaaagaaggaaaatatgtaaggattgaatatgatgaaacaaactcattgtatgtggaagatatgatggcatagatagaaaatccaaaggaatttatatataaattattagaatttttaaaatttttcaagcttgctgaaaacaaaataaataccaaaattaattgtatttctgtatacctgaaacagttggaaaaatagttttaaatagcatttaaaaattccaagcaggagttgcacattcctgtcagataatggcagctgcctaaatctctccacagtcttcaaaaaccatacatacacatacacacacaattttaaattatgactaaaaccacccataacccatctatagaataaccagaagacaaaaagtactataagtttatatttacaagtagaaaataaatatataaatctagccaaccttgctccagagagaaaccctgtctcaaaaaaaaaaaaaaaaaaaaaaagaagaaagcaaatgttggaaattaactgtcctataaaaacaaaagtgaattactaaatcacaagacccacaaacctctttggtcacatctattaaataaattacacttccatttatcaacagtagagggtactcctggctaagaaacctagtaagccacccagccctcatgtctgcctgcataaatcacctcttattgctgaaacaagaaaatgtaaggaatttctaaatgaacagaaaatagcatatgaagcagatggtattaatgttcttgagtttttattccctctttccttgaaaacctcatcaactttaggcatggccgtacggctcatcttgatcaatagaatgtgattggacatgacatatataccacttccaaatagaagctttaaatgtgattttgtgtttgacacactcttttgtgcctctgctccaggctccagactttaagcctctagaacgataagtgaataaatttcttttgttttaaaggcaccaagtgtgtggtgaatttgttacagtagccctagaaatctaatactaacaaaaagaatgttagagttgaattagaagtgtcagtgagaacttaggaatttaaaaaatcatattcttagcactgttcactgagggaatctagaagtaattacactgcagtaataacgagcccatcccatgcccaaatcttggtctctaactaccattttccagtcaaaagaatctgagctccctagagaaatgactttttcaaggctggatcaaggaaactgccaggcaatcttagatgatcttggtgatcttgatgtgccagaagattaatgggatcatgtgaaaagaacacagaaactggtctgaagggcttcctgttggccagatttgagacaatttgagcatcaaaaggaataatgagggtaatggatcataactggaaaatcagtttgcaaccatcaatgtacttactattgaatacttgtaaagaactttaagggttgctaataccattggataaaagcttgttgtgaaacagaatatttgcatggtctcaaagtctcactccacagattgttaggaaagggaaagggttacctttataaatatagagattaggtggacatcttaaccaagtgatcaaacttagcatcatcaataatgggacaatctggcatcgcatgccccctgatttaatgcagtaaggattaagtctaacaaaagatgtacaaagcctccaaatacagcgtaaacatttgtaaaataatctcagaacagggaccttaatgtttctcaaaaatttttccaaatacagaactttatttctatagatgtttatggtatatttgccatgctatatacattatgctatatattctatgtgctgaagatacaacaatgaccaaggtctttgcccttgtggaactgacatttggtggcggagacagaggaaacagtcaataagcatgtaaagagataaaggaaaagatactgaatgctacaaaggaaacaaataagttgagatttagaacaaaaaagagtcctattttacaagaggaataatgaggaagacctttctaaagaggtagctcagcactttgggaggccgaggcgggtggatcacgaggtcaggagatcaagaccatcctggctaacacagtgaaaccccatctctactaaaaatacaaaaaatgagccgggcatggtggcgggcacctgtagtcccagctacttgggaggctgaggcaggagaatggcgtgaacccgggaggcggagcttgcagtgagccgagatggtgccactgcactccagcctgggcgacagagcgagactccgtctcaaaaaaaaaaaaaaaaattgaggcagaatttcgctatgttgcctaggcttgtctcaaactcctgggctcaagcaatcctcctgcctcagcctgctgagtagctgggactccaggggcatgccactatgcttagtttaagaggtggtatttaaactgagacccgaagggtaaaaaacatggataaaagaagaaacagaaggggtaagagccttccaagcagagggaatcacatatacaaaggctctcatgttaaataaaacaagagttgacattgttgagaaactgaaagatcagctcatctgcgatgcggtaaaataggaggaatgcagtgggagaacagatcagagacttgggcaggggctatattaggcagaacttggagaccagagtaagggggccaaggtgggaacagaccgattaaattggcatctcttgggggggtgggggggtggggaacttacccatgcatcattttttaaaagctccaaaggcgattccaataagcagccagggttgggaacctagggggaaaatgtagctagatgaatgaagatggcccaaacgtcttttgttctgatagctaaactctctgtaggatcacagtgttacttcacagtgcatttgccaggaaaagtctcttcccatttggaatccgaagtaaaactgacaccacacttgaagatgccaggattgttagaggaaaatgtcacccaatagctccaggaagcaggagccctactgttgctgtttaaccacttctttcccattttggtggcaagttgcctccttttacacaaactgcctcaggagatcctaaagatatcatggtgtctgtctgtccttgcaagagcatgcattatggtaggacattgccttcattctgttcctttttctccaagactcttgcttattctcaccatttggctggactttctactgtaggattacctcggaatccacacaaaacccacagggtttcagagttgccttgaattacacgttttgaacattcagatcttcattttcccaaacatccacccagttataggtgacctttgctccaaagtcctggagtagcaaggtgccttgagtcttagactcttcccacttctttctctcttctgcatcccctcctgccaaggttgcccagccacactaaattgcatgccttgctgtgttgcattcgttatcattctaaagttgtcaccaacatgtgcgaaaccagtttatctaataacgatagctaccattttctgagctcttgccatgtactcctcttgccacagcaaatgcattgacaagggagtctgctggccaaagcctgactctcatctccagatggtccaacacagatgctgtgtgtgacccaggacaaagcacttaatgtcactgaggtttgggaagtgggtgagaacactgtagatataaggcctagctagagtgaaggcctccaaagcagggtgctcttaattctagatgtcccagatgcgtaggacagagtcatctagtcatcttccagggtttaatcctggactactggaaacaactagaagtgagaaaagcgtctgtgctttgcagtgaccattgtcctgtcagacaaccaataaatgctatctttcctctttcaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggagacaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttgataatcttattttggcattcttttcccattgactatatacatctctatttctcaaatgttcatggaactagctcttttattttcctgctggtttcttcagtaatgagttaaataaaacattgacacatacaaacaaatgcctttgagaattgtgtttttacactggaaataaaaatgtgaacactgatttttaaaacaaataggggcactgaatagcaagatggacactctagaaaaccaaattagtgagttagaaaaccagattaaattgaactcagagtaaaaatgatataattcatgagagtctgaataaaataaatcagaaatggagcctcaatccaggagaacagcttatatggagagagagagactgagagagaaatgggagtttctgttcaatgggcataaagtttcagctatgctgctgggcacagtggctcatgcctgtaatcctggcactttgggaggccaaggcgggcggatcacctgaggtcgggagttcaagaccagcctagccaacatggcgaaatcccgtcgctaataaaaatataaaaattagttgggcatggtggcacatgcctgtagtcccagctacttgggaggttgaggcacaagaatcgcttgaacccgggaggcgggtggaggttgcagtgagccaagatcgtgccgttgcattccatcagcctgggcaacagagtgagactccatctcaaaaaaaaaaaagtttcagttatgcaagatgaattaagttctacagatctaatgtacaacattgtgcatatagctaacgataccatactgggcacttaaaaatttgttaagagagcagataccacgttgtgttcttactacagttttacaacaatgcaaaaatgcattgtaaacactatgtgcaaatagaatagcaaagaatgtatacagtgcccatgagcataacattctagtggacccacaatgcatcagagttcagtgagactcaaagggagaagaatgttggcaaagtcagtggggaggagaaaatgagtgtgatgaaataggcggtctcattaaacttcccttacaaaacacaagatcaaagataaaattattaagaatttcgagacagtgacatcagagcaaacgaaacatagg

SEQ ID NO: 3 - DNA, 188930 bp, Artificial Sequence
  synthetic construct
tcaccatggctacattctgatgtaaagagatatatcctatacctgggccaaatgtaaacagcctggaaaagtgttaggttaaaaacaaaacaaaataaataaatgaataaatgccaggtggttatgagtgctattgagaaaaatgaagccaagagggatatcagtgatgcaggtgggggtaaagagcttacaacataaatgtggtgttccatatttaaacctcattcaacagggaagattggagctgaaatgtgaaggagttgtgggagtggaactacgtggaaatctgggggaaaggtgttttgggtaaaagaaatagcaagtgttgaggtccaggggcatgagtgtgcttgatattttagggaagagtaaggagaccagtataaccagagtgagatgagactacagaggtcaggagaaagggcatgcagaccatgtgggatgctctaggacctaggccatggtaaagatgtagggttttaccctgatggaggtcagaagccattggaggattctgagaagaggagtgacaggactcgctttatagttttaaattataactataaattatagtttttaaaacaatagttgcctaacctcatgttatatgtaaaactacagttttaaaaactataaattcctcatactggcagcagtgtgaggggcaagggcaaaagcagagagactaacaggttgctggttactcttgctagtgcaagtgaattctagaatcttcgacaacatccagaacttctcttgctgctgccactcaggaagagggttggagtaggctaggaataggagcacaaattaaagctcctgttcactttgacttctccatccctctcctcctttccttaaaggttctgattaaagcagacttatgcccctactgctctcagaagtgaatgggttaagtttagcagcctcccttttgctacttcagttcttcctgtggctgcttcccactgataaaaaggaagcaatcctatcggttactgcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaaggtaaaggcatgtcctgtagggtctgatcggggccaggattgtggggatgtaagtctgcttggaggaaggtgcagacatcgggttaggatggttgtgatgctacctgggccccaaagaaacatttctgggtaaggtgtgcacacatctgtgttattagcagaaatgctaactgccaattcttttcataggtctgacctatttgttgatattttgttctgttttgtccattgcttctcttcgtcatatgctgctcctccagaatctagagactggagtagagggagggtgaagggacaaagacaaaacttccctctgcctgcccaagcttccatagagagaatcaaggcaatgaaatccaatcaatatcacacacaagtttcatgtctggttctcttgtgtgtacatgcaatgtgtgtttttataatatcttttcctactttgggtgtaaggataatatgagccttgagttcagaagcttttcgtgttttgggggttctggtgcatttaggcagagtattaaataactttatcaatattgtctatggtcatcagttgattcagatttttctacctcttcttcagtaaatattggtatattttggtctatactttcatagaaagcaatctactgtccctagatttgataatgtattggtatcaagttatgtaagagtctcctgtgattttgttaaactgttctgtgtctgtagttatattttctttttcattccttatgttgtatatgttctcttcctctcttttaaaaataatatttccaggagttttcttgattttattggtcttgtcaagaattttcttttggtttgatttatcaatctcttttttctttctgttgcatcagtttctgcttctactttcattgatttattccttccttctaatttcctttggttcattttgttgttagatttttgcttcttgagttgaatgctgaaatcatttattttatttttttgtcttctttaaatgtgtattataaagatttaaatataatacatagattgtggctgtgtaaacattaaatgtggtcatgttgtacatactttatattctttttggttctttctgtttggctccccaccctctttccacatcagtccccttctcccccacctcagctaggtaaccccagtatgataatatatattcacatacacatacacacacacaaaggttttcttggacattatttgttttataaaattgggacattatacacacatttctcactcattaacacgtactagaactctaagtcaattggtatagctttaattcattatttttattggctatataagattctatggtatggctgtatcacaatttagtcaatatgttcactttattccagtttttggctactatatcctatatcattacatactggtgcttttacttctgttgaacaaacttgcaagaggaatattaatggaacgaagggaatgtttccttctaagttttaatttccaaagaggtcagaacttttcaaacatttctaccatcgaagtatgaaaatggccttctctctgcattcacatagcgataagttttatcctgtttttaaaatttgccaattttacaggtgtagagtgatattgcatcattactttcattgtgttatttttatttctaataagttgagcatctttttaaatgcttgttggctattggatttatttgggggatttaattagtcatatgatttgcccattattctttggactctttcatttaaaaaaattatgagaacccttttattattacaaatattaactctttgtcatgtatattgcagttttccccaagatctattgtttgtctgttgactttcttataacttttaccaaaacagtttttaatttttataatcagagatatcttttctttcatatcttcagagtcggcaaggttggttaaaaatgtttcccacacctcaagattgtacgtgtaatctcccagattttcttgcaagatgtttactgtttcgctttttatatgcattgcttcaattatctgctaattacttttgtcatatggcatgagagagggatttgtctagttttatttccatccagatcaatagcctattgtgatggcaccttttgccactgatttgaatcaacacattcatcatataaagttctcatatatattagcatatatttctggattcattaggctgtttcactaatctactattatcttgctatgccagtaccatagtgatttgattacagtgagcctatgatatcttctgatatctggtgggtgaaagcaatcctcactattctttttgtacctttcttagctattcttagacactttattcttccacataaaactgttaagatatttttcaaattaaaaagatccaagccctgttgtgattctaactgcaatttcattaaactcagaccttaattttattaatgtaataaatttaaatatttttcttattacatttatctctgtgtattttataagtgtgatgctattgttaataagatagttttctcctatttccatttatgagtgcttagtaccaaatagagataagctattggtttgtgtattttcagctttttcttttgagcctgggtctcattttgtcacccaggctggagtgcagtggggtgatctcaccttactgcagcctcaacctcctggattcaagcaattctcctgtatatcagccccccaagtagctgggactacaggagcaggccaccatgcccggaaaatttttgtatattttttagagatgggtttttgccatgttacccaggctggttttcaactcctgagctcaagcattccccccacctcagcctcccaaagagctaggattacaggtttgagccaccgcacccagccattgtatattcatcttaaatctagctaccttaccaaatttgcctattaattctagtaattttaccctaaagtctctgtgagtattgaatcatatcataagttaaatgagacagattttagctcatttccaatatttatagccagttatttcattttcttatcttattgaatttattagaaaacaagagcaaatgttaaataataacaatgaaagtgaacattccttctactctatgattttacttgaaataatttttgtattttgctatttagagtaacatttgctgttttggtttttgtaaatggtgtttattctattctcatttgccacaaaatgtttatcataaataagttttcagcagctggtatcatctgaattgtcttctttgatatgctgatgaacaaattatgttcatagatgtcctgacactaaatacccttacattcttggagtaaaatctactattcatggaatttgatcattagtgggttctatgtactatttctttagactattcttagtagattttcactactcaacctactaataataataaacaaagttttgttggctttatcaaatgaattgatgagtactccatctttttctattgcttagaatagcttaagtaacatttgaattatccattgtctaaaagttaggtgagactcacttatgaatccatttggtcctagtggcatttgcaatatctttaatcacccctccaggctcttctatgataatcagtcaattcaagtttcaacttccaataattatatacctttctaggaagtaactttatttattttttcaattttgttgccacagtgttgcatgtagcactcactcatgattcttttactccacattatctgtagttatgtgccctttcttattcctaaattcctctatctttgctatttatctttttttccttgaataagcttgccaatgacttgtctattttgttgctggtggtgctcttttcaaagaatgggcttttggattttttttttttctagttggtataaagcatttttattttcactgagcagaaaaagaagctattgattcattaactgtgctgctttattggcatgtagctatgcactgttcacacattaatatataaaactcgtcagtctgttttattttgtctgatgggaaaacatgaacagtgagatttcttatgcaaaaagtgaacagttcaactatgctagctccatatacctttattaacattccagagacttatcctctcaacatgatctgatttctgtaggataacttttcaggaaaagtattttctgatcagtgaagcttggagatataaataagcaatcggccaggtatggtggttcatgcctgtaatcccagcactttgggaggccgaggcaggcagatcacctgaggtcaggagtttgacaccagcctagccaacatggcaaaactccgtgtctaccaaaaaaaaaaaaaaaattagctgggcatggtggtgctcacctgtaatcccagctactgaggaggctgaggcaggagaattgcttgaacctaggaggcggaggtggcagtgagctaagattgtgctcagcctaggtgacagagtgagactccatttcaaaaaataaaaaaataaaaaaaagcagtatctctcatattcattaactggaccctgactttcttaaagctcaccccaaagctgaagtccatgaaggcactagttctcaaacttcagtgtgcataagaatcactcgggaagcttattaaaatttacattcctaggccccatcctcagcaaactatttagtccccaggtaattctatcccaccccaccccagctttattgtggtataattgacaaataaaagttgtatatatttaaggtgtacaagataatgttttgatgtaagtatacattgtaaaatggtatagcatgaagggttttcttttcatttttttcagaatagtttgtaatatcttctttgatttcatctttgataatctagacgtatgattttaattgctttttaaatttgtttatcaagttagtttgtagtatttgggtcaacattgaatatcctgttaatttcctattgctgtgtaacaaactacatcaaatgtatcagcttatgacagacccatttactgtctcacagtttctgtgagttagaagtccaggtggactcagctggatactctgtgcagggtcatacaaggccaacaccaaggttttaatagggctgcactccttagtgaaagctcttggggagaatctgcttacaggctcatttggaatgttagcaaattcagttccttctctcactttccatgtagtgccctctaccagcaatggtgcatcaacactctctcatgcttggaattgctctgacttcaattttccgtgcatatctctggccttttttgcctctctcttttacttttaaggactcatgtgattacattgggccgacctgggtaattcagaatactctccccatctcaaggtcagctaatcagccccttaattccatctgcaaagtttaatttgccacataatatatttttggacatgacaccaaggagcaaaggtgatgtgggccaaatttttacctgccacaggtatagtttacatacaatgaagctcatcaattttaaatatgcagtttgatgagttttgacaaatgcatacacttgcataaccaccaccctaatcaacatgcatttacatcaaccctcctgcaactttttaatgagtctctcccactgacctggcctcagccaataaactgctatctggaagttacagatttgttttcacatgttctagaattttacatcagtggaatcatacggtatgtattcttctatggctttttttcttcagcatcatgatttggaaattcatgcaggttgttgtataaagtatttctatcctttttattgctgattactgctccattatgggattatatcataattttggattatttccagttaggagcaaatacaaataaacctgctatgaacagtgctccacatgttttgtgtgaacatctattttcatttatcttagttaaatatctaggagtggaattgctggatcatatggtaagtgcatgtttaagagaaactgccagacagatttcttgaacgtaccattctatactcccaccagcaatgcatgagagttccagttgcaatatatcctggacaacatttgatgttgccagtacttaatgactgcacagtggtatctcactatacttttttttttttttgagatggaatctcatcccatcacacaggctggagtgcagtggcgcaatctcagctcaacatctgcctcctaggctcaagcaattctcatgcctcagcctcctgagtagctaggactatggtcacacgccaccgtgcccagctaatttttgtatttttggtagagacggggttttgccatgttggccaggctggtctcaaactcctggcctcaagtgatccacccgcctcggcctcccaaaatgttgggattacggcttgagccactgcacctggttatacttttaatttgcgtgtctctgatgactaaagatgttgagcatctttgcatgtgctaattagccattcctatatcttcttggaagtgtctattcaaatcattggtcctttgtttttaaacgtagtttcaacttttattttagactgaggaggtacatgtgcaggtttgttacatgagtatgttgcatggtgctgaagtttgggttacgaatgaatgatcctgtcactgaagtagtgaacatagtacccaataggtggtttttcactccttgctacccttcctcctccctctttcctctagtcgtctccagtgtctattattctatgtccatgtgttctcatcatttagctcccacttctaagtgagaacatatggtatttggttttcagttcctgtgttaattcacttaggataatggtttgccagtttttaattgggttgtttgtcttgttattgttgagttttgataattttttatatattctgggtacaagactattcagaggtacctgttttgaatgtttttttccaatctatggcttgcattttcattttccaaatggtgtctttcaaatagtggaaatttatagttgtagttaagtccaatttagcttttcttcttctatgattcatgcttttttttcccctgtcctaggaaatctttgcccacctcaagttcacaaagcctttcttctgttttcttctagaacttttatcattttagcattagtatttaggtttataatacattttgagttaaattttctgtatggtgtgacttttctttctctattgaattcccttggtgcctttgtagaaaattaaatgactgtatataggcaaatctgtttatggattctctagttccatagatgtgtatatctgtgcttatgccagtaccagattgttttgattgttgtaactttatagtaagtcttaatatcaggcagtctaaaacctccaacttacttttttattgaaattgcttttgatatatttaggcttttatatttctgtattaattttatagtcaactagccaactccaccaaatagccaactgggattttgactggaattgaattgaatctgtagatcaatttggggagaattgacatttaaacaatactgaatctttcaatacaacaacatggtatggctttgtttctttaaattttctttaatttccctctaggatattttgtagcctacagagtagttcttgcaagaattatattaattgtatccccaagtattttgagggattcgatgctattgttaattgtatcatttttatttgttttcgttttccaatcatttgttactaaaatatagaaattcaattgatttttgtatattgaccttgttcactctaatcttgttaatttgcattttagctctagtagcgttttgcacttcttttagaatttctacatatacaataatgttgtctgcaaataaagacagtttgcttcttcctttccaaactggatgctttttattttttttttcatgccttactgtactggcaagggcctccagtacaatgttagatagaactgatgatagcagaatccttgtcttcttcctgatttcagagggaaaatattcattattttaccattaagtacaattacttgtaaattttttcatagatgccctttgtcaaattgaggaagtttccttctattcttggtgtgagagtttttatcaagatttgatattagattttgtcaaatgctttttctgcatctattcaaatggtcatatggtttatcttgtttattctgttatggtgaattaccttgattgattttttaatgaggaactagctatgtattcccagggaaaaaatccacctggttgtgacatattacattggtaatattttcgctatggactgaattgtctccacctccccccaccccaaattcatatgttgaagtcctaactctcaagatgattatatttggagatagggcttttaggaggtaaacaaggttaaatgaggccataaggatggagtcctaatctgataggactggtggcctcataagaagagagaaggttctctctctacactcatgcactgaggaaaagccatgtgaacatacagcgagaaggcagccatctaccagctgggaagagggctccactagaaactgaccgtgctggcaccctgatattggatttccagcctccggaactgtgagaaaataagtttctgttgtttaagtcacccaatctctagtattttgttatggcagccctggccaactaaaactgttttgttaagggttttggtggtgatggtggttttttagtttttgcgtctgtgttcatgatggatatttggctgtgattttcttataatgtcattgtctggttttgatataagagtggtattagtccgttctaatgctgctatgaggacatacccgagactgggtaatttataaaggaaagagatttaatggactcacagttccacatggctggggaggcctcacaatcatggtggaaggcaaaggaggagcaaagacacatcttatatggcatggtggcagacaagagagcattgtacaggagaactgccctttataaaaccatcagccctcatgagacttattcactataatgtgaacagcatgggaaaaccccactgccatgattcaattacctcccacctggtccctctcacagcacatggggattgtgggagctacaattcaagatgagatttaggtggggacacagccaaaccatatcaaagagtaagactattctttttttttttttttttttttttgagacggagtctcgctctgtcacccaggctggagtgcagtggtgcgatctcggctcactgcaagctccgcctcccgggttcacgccattctcctgcctcagcctcccgagtagctgggacgacaggcgcccgccaccacgcctggctaattttttatactgatagtagagacggggtttcaccgtgttagccaggatagtctcgatctcctgacctcatgatccgcccacctcggcctcccaaagtgctgggattacaagcgtgagccaccgcgcccggctgactattcttataaaatgagttgagacgtgttcactcttctatttaatgaaagagtttgtgtagaattggtatcatttcttttttaaatgtttattcaccagggaaatcatcttatcccagtgttttttgttttggtttggttttttttttaagggtcttaattgtgaattctatttttaataggtaaagggctatttgaattttctatttcttataggataaattttaataatttcttttaagaaattccatttgagactgggcatggtggctcacacctgtaaccccaacactttgggaggaggcagcaggattgctctaggccaggagtttgagatcagcctgggcaacataacaagacttgacttctacagaattttttttcattagccaagtgtggtaacatatgcctgtagtcccagctacttggaaggctgaggcaggaggatcacttgagcccaagagttcaaggctgcaattaactatggatcatgctactgcactccagcctgagcaacaaagcaaggctctgtctcaaaaaaagaaaagaaattccatctgagctgttgaatttaatagtataaagttcagaatatttccttaccattttttcactccttggaggtatgatttacatactgtaaaaatcacttattttcagtgtggagattcttttcctttcctaaatctccacatttttattgacatatactttacatatcataaaattcaccatttgaaagtgtacaattcagtggtttttagtgaatccgtaaagtgtacaactatcatctttatttaattccagaatattttcatcacctcaaaaagaaaccctgtaatcattaaacagtcacttctaattttcttcctttccccagcccctggcaaccattaacctactttccgtcactgtggttttgcctattctggatatttcatgtaaatgaagggataaaatatgtggccttttgtgtctagcatcttttgcttagcatgttttcaagattcttccatttttgcagaatgatagaggagttaaaataagaaaataaagatatagtaagaatgaaactattttcattttttaatttaaaaaaatcttccatgttgtagtatgtatcagaatttaactcctttttatggctgaataatactccattgtatggatagaccacattttgtttatccattcatctgttgatggacttttggattgtttccccttttggctattatgaataatgctgctatagaacattcatgtacaagtctttgtgtacatatgcttttatttctcttcggaatatacttaggaatataattgctaggtcacatggtaattctatgtttaacttttagaggaactgccagactttttcaaagcagctgcaccattttacattttcactaccaaagtatgagtgttccaatttttccatattcttatcaacacttgttactgtctgtctttttaattatactcatcctagtgtggataaagtgatatctcattgtagtttggatttgcatttccctgatgacttacgttgttgagagtcttttcatgtgtttattgaccatttgtgtatctcctttggagaaatgtctatttaaatgctttgcgtgtttttaattggattatttgttttttagtactgagttgtataagttctttatttattcttaatattatacccttatcagagctatgacatgaaaatattttttcccattctgtgggtagtattttcactttcctaatagtatcctgtgatgcacaaagtttttcattttgatgaaatccaatatttatttattttacccctttggttgcttgtatttttgttgtcatatctaagaaatcaatgtcaaatcaaagatcactaagatttaaacctatattttcttttgagacttttatagttttagttcttacattgaggtcattgatccacttggagttaattttggtatatggtgtgaggaggggatccaagttcgttctacagcctatatagcctgcagatgagcaatgttagtgaccttgaaagtagaggcccaggttgtcagtagcctggcatctaactaaacaaccatttatccattaaagttagccctgttaacaattaatattgagataattttacttaatacactgtgtatattagtgtccatctagcatgcagcctgaggcacagagaataatagtttgagtataaaattgaattgaatggaatacatcattaatttattatctagctttctgttattgtataggcagtcacatgtatttaccagaaaaaagttgatagaatttttattttaatgaaacccttttatactttagattattttgatgctgattaacaggataagctgactctggacacatcctgacagcctctgccaaggtttgaaataaacagctgggaaaattcagttttatattatctgttcccgcagctgctcagtttcttctaaccacaggtcagggaatataataggttttccgattagttttagataaaatgtgaaagaacagttcatgtcaaggacaatggttgccaaatatatttggcaggatttctatattgaatcccaaaggaaatacacaaacaaaaccccacaaaagttaggaaggagtaaaacccaggaaccctggaacattttgtcatttactatgcagatttgcctgaaagtgagacaggcaaataaatcacatgtttctgccagcgtggaaaatattcactcaaatggcaaaggtctcaggctggggagctggatattgtcctgtaataggttcatctcagaactgaatcacacacttggagggtgttaatgctcttaggaacatctagttattccctttgaatagagtcctgtcctgaatcacatatacttgacctagggcctaggcctttttgtttttctgtctcacaatcttgtttctccatcaattatgtgttttcactcttccctcagagagggaaaaagtgtttctgtgtgctcttgatcctgttccctctctgatcttccaatctattgctctataacatattttatatgtgtcttatatcttcattttagtcagaaacatttatttatttatttatttatttattttttgagacagagtctaactctatcccccaggctggagtgcagtggcatgatctcggctcactgcaacctctgcctcccgtgttcaagcgattctcctgcctcagcctcctgagtagctggcattacaggcatgccccaccacgcccagctaatttttgtatttttagtagacagggtttcttcatgttggcccggctggtgtcgaactcctgacctcaggtgatcctcccgcctcggcctcccaaagtgctgggattacagatgtgagccattgggtctggcctttaatcagaaacatttaaagtgaaagcactgtggtaacttatgttgaaataccttagaaatcaatggaaactgcacagagagggggtaggatagacgtagtggaaccaaggatatgatatggaaaaaggagaaaggtagcaaactagggatgagttggtgaatgtggaagggcataataatgttaaatgactgaaaactacataggcttatgttaagactagtgccatggaaatttttagaggtagatgacattagagtatgtttaaatataaattaatgttcttgcagtgagccgagattgcgccactgcagtccgcagtccggcctgggcgacagagcgagactccgtctcaaaaaaaaaaaaaaaaaaattaatgttactggttgtgttccctagatgtagactctgagatgaagattaacatgcaggaattttatttggagtgttcttgggatcaacacctgaggaatcagggataggcagagggagaagcgcgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccaatggctgggactggggagttctttcctagactgccatccgggcgcccctcaccctcttgctgctcagctccaggtcgtcgtgggttcagggctcagctgcacgctcctgcccgcgccctgggcgtgatggcacccccagcccctgccattcttccccctcaccccctctccctgccactgctctgcattgccctgggttagcctggcggggccaggtggcacccgccgtatactcttgcctttctgctgcaggggcctttctgctgcgggtcccagagctgcagggaggggcggcagagactccccacgtggctcattggcgggggtgctaatcagagttcttttgctgccactctttgattcccaaaccccatgtaatcttcttagtggggacacagaatcatctttgaattcatacatatacagcaccttggaggctggccctccatcctcacagagacctgcctccaagctggagttctacctgtgcctggttgtggacccactccctcatctcttttgctgtacaatgattccccaggtctacacggtgctatatggaattccacatcagtgaatcaaatcctctgtaagatttcagatagtggtgctggctaaggccctgaagggaggaaaggctaagttacgccaagattaggtatcacaatgaagtcctgtcctttctaggatggaaggagttcagtgtgtctggccaccgagaagctggtttgtctctgtgatggacaataccatattgcagcaatccccaacctttttggcaccagggactggtttcgtggaagataatttttccagagactttggggttgttgggaatggttacggcatgaaactgtccgcctcagatcatgcggcattagttaggttctcataaggagcacaaaacctagatcccttgcatatgcagttcacagtagcattcgcactcctatgagaatctaatgcagcagctgatctcacaggaggcagagcccaggcggtaatgcaagtgatggggagccgctgtaaatacagatgaagctttgctccctgcctgctgctcacttcctgctatgtgaccccattcctaacaggccacagaccagtactggtcaggggcccaggggttgggcccaatatggcatattgggagctcagcattgatttttgttgctggcaggttggactttggtggcaacagtagctagatcagccttagtcagtgggaagccacgcttttgggtccatgcattaattctctccctgctgctgtagccacttagctcatgtcttgccagtactgcgatggcctatgcagaggctagctgatgtgaattgccagagtcatttttatatgtgttgttggtttgtgcttccttcaagatggatgctttctgttggcattaacgtattacttggagatttttctagtttgtgtccactcactaatatgcctttgtcccaacttttttctggaagagcttccttatcagtacgctgggccctggccctcagccagtacagaaagtcatttgtcaaggccttcagttggcagacgtgctccctggactacgtgctttctcgggtgtcccagaaaccctggaatggagtgaaatgcagggctacgtgggagagcagggaggcaagaattaagtcggccccacctttgcccaactcagtgggtctccttgagagaggtctgcagtttcaaggagacttttcagccaatctgctgcgagatcctgtgaaggggtgtgaaggtcttcctctgtgactatagattggccagtctctccttgtgtgtccaacagttttcattatactttatgtgaattaatgcaaaactgctaggtttaaactgctcaccattttagggatcccttctggattttaccttccttaaggggaaattttcctcctttcctcagttcatcctttctgccttggctttgacgtggtctggaggccacagagcctcctcctgagaacctctctctggtgtgtctgtttgtgtccgtccctctcctttcgatcattccctgtggttcctgttgggcgcggctcccataaacgcacagagcagggtctgctttgtctgcaacctgatgcattgttatttctcaccaaaacttgcagtccaaacatcacatttccgggccacactctttgtcagagctccaggggcacaaccccggggacctgctggaaggtgccaccgtgacgtgtgcctagatgcgttttccctcagttaccacagcgttcctctggttctggtggctggagggtgaccgcgtgcttcatgaagggggtccttactgcttcgcatccacccttttcacggaaagcactttgtcacatgttttcagtgtttctaagcgattttctgccaatcttgtgtgctaagattgtgtggcagcgtttccacagatttatagctggcaatgaattctcccaaaggaaatcagacaaaataaaatgtttccaacattgttcacatactgacaacttatgtgcttccttgggtgattttacaactttttaagcacatgaataaaaattattgtctgcttttttctccttttttctctcttttttttcttgcatgcagaaagtttataggagggggatcctctggatcaacacccatgggggagtgaaggaagcaggattgggtaaaagaagttgaggtgatacagtctgaataaaggtcagtcccacagggagctcaagctaggatggctctgcagagatgttctctattgaggcaagttgtctggacctatatagtcccacctttaccaggaataaggcatgagtttggatgtggtgactgacttcagccaaaattggttctcagagaggaattcagattagagttgtcagctgtcagcacacccagcagcttaggaaataagtgctttagtcctgaagcggtgaatctggacaccagcctccactgtggtccaccctttctgctgctcagattcatttgcttcataagttctggaatggttccttcaggattctgatgggctccctttcctggggaaacaaaagagaaaggtttggaacacagcacaactcctgctgctttagcttttcttgagtctgcaactggtactcatcatcttccccttctactacccattctagatccctccccccaccaccctctcaattcatacttctgctgctccaagtgggttaccagataaggtatctggtcatcatgccctttgtaagccatgactgtacttgtccatttatcatcaacattgaacaagggaatactaagagatacccaggcagatgacctggctgccaaatatattctcctctgtctccattgtgtaatgtcagcccttcctcctgatgatcaggatcggttacgcttgccaggatagtgactcttttccttacctcttggtctcttaatagtgatctgaagtaatatgatggcaaccatagtttcaagtttaatgagactcttggtgtgtccactggcggacatattccccttttaagaaccagtacttctaaactctcagagcccagagttgggataagaggcatagtttccctaattgggtcactgggagtaatggtagtgtgaggctgctcctacttacactccttgttttccaaaaccatatattttacttcgggacacaccccactaaacgatggccattgatctagagtatatactgcatcctgcaggatggtgcctcgtccttaggtattatgtctaagctagtgcctcagctgtgccttcaacaagctgtcctaccactctatcaagtgggtagcttctgggtagtggattccatggtcatgtatcttcttgctttaaagtaggtctcttggtctgatgcagtgttatgtaagatcaaatattctgtgaggccttgaatggtggtgtttactgaggctcaccaagcaactgaatgattttcttgagaaatggtgacatatcagagccttagctttggtctctgttactggcaagttgaacattaacaacatcagtagctagatctgtattgatgagtccatgatgttgggcccatgcatagcctctgccatggctcctcctttcatacatccattttgtaagaattggggcaccaacagcagagactggtaagcatcaaagtggctaagtcattcagtctacttggttgtttagtgctgtttctgtggctgatgttcttttcatttattcattctgtaatgcgtatcctttgtagattcaatttccttctctctgaacaacttctttggatatttattgaaaggcaggtctactgtcaataaattccttaatttttattgtctgagaaagtttttatttctccttcatttttgaaggatactttcacagagttcagaattttaggttgactgttttttctttctctcaacactttaaatatgtcagtgcactctcttcttgtttgcatggtttctgaggcgaagttggatgtaatttttatctttgctcctctatggataaagtgtttttccccatctggtttcttacaacattttttgtctttgattttctggagtttgaatataatatgcctaggtgtagggtttttttatttgtttgctcgtttgcatctatctttttttttttttttttttttttgagacagaatctcgccctgtcacccaggctggagtgcagtggcgcgaactcggctcactgcaagctccacctcttgggttcacgccattctcctgcctcagcctcctgaatagctgggactacaggcacccgccaccacagctggctaattttttttgtattttttagtaaagatggggtttcaccatgttagccaggatggtctcgatctcctgacctcgtgatctgcccgcctcggcctcccaaagtgctgggattacaggcgtgagccaccgcgcccagctgcatccatcttctttggtattctctgagcttcctgaatctgtggtatggtgtctggtgtctgacattaatttgggggaaattctcagtcattattgctttaaaaatttgctcctattcatttctgcattcttcttctggcatttccattatgtgtatgttacaacttttgtagttgttgttccacagtttttggacattctgggcccatgcatagcctctgccgttgttgttggtgtttttttttttttcagtctttttttctctttgcttttcagttttgattggaagtttctattgtcatgtcctcaagctcagagattctttcctcagccatgtctcatcaaccaatgagcccatcaaagacattcttcatctctgttacagtgttttgatctctagcatttcttttttattctgtcttagaatttccatatttttccttatgatatacatctgtcattgcatgttgtctactttttacattaaagccattagcatattaatcatagtttaaaaaattcctggtctgataattatgacattcctgccatatttgactctgattctgatgcttgcttgttcagtctcttcaaattttgtgggttttgccctttagtgtgccttgtaatttcttgttaaaaggtggacatgatgtactggctatgaggaactacagtaaataggcccatagtgatgtggtgagatggaaagaaagaaaagatgctcaacatcactaatcattagagaaatataaatcaaaactacaaagagatactgcctcacacccattaggatggctactatcaaaactaaaacagaaaataatgaatgttggtgaggatgtggagaaattggaacccttgtgcactattgcaaatgtacaatagggcagtttctctaaaaattaaacagaattaccatatgatccagcaactcgacttctggctatatatgcaaaagaactgaaatggggtcttaaagagatatttatacatcaattgtattagggttctccaatgaaacagatccgtgtgtgtgtgtgtgtgtgtgtgtgtgtgtgtgtaaatatatgccaatggtaaaagtacagggtctgagtcagaaggcagaaccaagaatgcttatgtccaagggcaggagaagacagatgtcccagttcaaacagggagagtgaatttgcccttcctctgtctttttgttctattcaggccctcagtggaatggataatgcccacccacattggtgagagtgatcttctttaccaattcacatgctattctcttctggaaacatcatcacagacatacctagaaatactgttttgccatgtatctgggcatctcttagcccagtcaagttgacatataaaattaaccatcatatccatgtttataagcagcattattcacaatagctaaaatgtggaagtactgcaagtgtctattgacagatgaatggataatctaaatgtggtatatacacacaaagcattacgaaagaaggaaattctgacacatgctacgacatagatgaaccttgagtatattacgctaagtgaaataagccagtcatgaaaagacaaatgctgtatgattccacttatattgggtacttagagtagtcaaaatgatacagaaagtagaatggtggatgccagagactggaggaggtgagagttattgtttaatgtttatacagtttcagtttacaacataaaattaattctggaggtagatgggagcatattacacgttttctttttggagatgggatctcactctgttgcccaggctggagtgcagttttgtgatcatagctcactgcagccttaactgtctgggctcaagtgatcctcccaccccaggcaccaaagcagctaagaccacaggtgcacaccaccacgcctggctaattattattatttgtagaggccaggtactgctgtgttgcccaggctggtgttgaacccctgggctcaagtgatcatcctgccctggcctcccaaagtactgggattacaggtgtgtgccaccacacctggccagaatatttaatgctactgaactgtatatttaaacatgcttgggctgggcatggtgcctcatgcctataatcccagcactttgggaagccaaggagggtggattgcttgagcccaggagtgtgacaccagcctgggcaacatggtgaaaccctgtctctacaaaaacattaaccgggcatggtggcacacgcctgtagtcccacctactctggcggctgaggcgggaggatcactcgaacccgggaggtggatctcgccactgcactccagcctgagcaacagagtgagaccctgtcaaaaaaaaaaaaaaaaaaaaaagatttacgatagtaaattttatgtgtattttaccacaattattaaaattgaagaaaatccccatgggtcactggtttaccaatttagccattttcaccatttttagattgcattttccttctctatctcagcattctgactaaaggaaaagcaaaatttcttacaagaatgaatgattctccagtgtggctgctcctgaaaggaacaatgagacttttgttatttcaccacaagactgagaaagaaataaacaagtgataaatgcccagaccccttcttattcattccacatcctggtaatctgaggcatggtgtggcttttactccaagcatatgaatacttacaatcagaagctgcctctcctttccctcactttatcattattgccatcatttatgacaatggagggagtgtctcactggatgatatttggggttctttcttcagtggtccgccataccaagcatttatttgtgctgttctccatctttcacatctaccacttttcaaaagtccctgagagtcaataagacatgcgactcgaacaactgcttcacatctaagtgtatgtctttaaaaatctctccttttccatgtttatgtctgatgtgttttgttatggcaaagtggcatgtagtatacggttcataagtgaatcgatgtatatctgtggagggcaaatgctcaattttagatctacacatgaaagcttttttccagggcaggagccttgctttctccaactaagccttaattacccaaatgcccatgtgttgtgcctttggcttgttgaaatgataccaactggtaaaatctgatgggagataaaagttagatgtccagaagcataaaagtcaggaagagaggctctttatggcatagagaaagctgcagaactgctccatggtgtgcaaaactcatcagcacatgaaactagtgagtggagatagtcaccttcaaccactttgtaatttctaccaattcacttggggccagtgtcccttattcaccaagattcacattggtccttttgattatttggcgtgaggaggcccccagacatgctaaactgtcatgcagggagagaggaaaagttgggaaccagcctttgcttaaaagggctttgacaatggaggcaaataataacattttgggaacatttatataagtaattatataatttctgattcagtagctggttcatgaataaatgagtaattgggagtatctgagtggagacaagaatgaacattaatgtaggactgattctgaattacagcttctggcactagtaggtttcaatatacatagtctgctgaaaggtaattttctctgtgatattcctggtatccctaaggagggaagtataattttaggtacatactgacaaaatttgaacacaaggtacttagatgaaagttatagtctgttttagagatgaaattgaaggatgcagtagctattgctttggcaaaggatttttggctgatgcagtgtatggttattgattttatgattcttatcatatggcacctaatgtatcagttgagttgtgaaaacagtgtttcggtttaatggatgttagggatttatatacaacttcaaatttgcctccttgctaatagtagaaaagagtagtatggaagcattacttccagctgctttttgaagtgtccaccaaaatgaacgactttttcctttcttcacgcagatttcctcctagagtgccaaaatcttttccattcaacacctcagtcgtgtacaaaaagactctgtttgtagaattcacggatcaccttttcaacatcgctaagccaaggccaccctggatgggtaatgaaaacaatgttgaatgctatttatgaaattgggtatcttattttctatcacagattccccaatcttgaggttgcagttaaaaagtgcagctgccaaagagaatgtttccctaactgctacctatagggaaatacactgactgcattttctgtctttttgctgggccgtcttcctctgcttggtctatgccaactgcttacctccacttagatgtcaaataaagtatgtaacaacatgttatgacaggacattttctgtcttagaattgttgctgagaattataggtgggaagtatccccttattctaaagagagatatcagcctatcgatttagaacttgttcaggtagtagtccaaaattggttctgcaacccttaggccctgactcacctccaaccttgtataaaaaaaggctaggaacttatggaagactttagatttgaatatttattatttggagagcctcttcggtgttttatgtgttgcttaccccatggggagtgggaggcctgtccctcatgtcaaggtataatgaaggaggcttcaggagaaccacttagaagactggacaaggtacctatggaacttgggagacactgaccactgcctggtttttatctggataaattttcaaggtcagaggccaaaaggacttctcctgatggaatagcagggggagtgggcaatagtgggagctaactgcactaccattgttaggtgtaaggccaggaaggtcactgaatgggacttgtcttacaaagactctgcctgagaggtcttcctgccaggattagataaccccaatagaaaaagcctgtatgggttgtactgccagaagcagaatctgagaggagagatacaagtgaccagctggagaaggtatatcccatgccaagatcaggagcagtggggtgtctccttgttggcagggagaggtctccaaataactcataagttccctaagaaagaaaggcagaattttggtatgtgtcacaactagggagtactaatgccacattatcactgctccttccaagaaagactttgtcattgtgcctatttgtttttaccctcccccctcctttccacttgctcctaccttggcaggtccagagacacaaaggtgagttggggaggaagattaggagaggaaggtgggaaagcagcgaagctgccaaaacaaattacctttacatattgcagatttctggggctgtcagaatgtagctggagaaggaagggaacttgcaattgcagaagacatcaaaaatttggtattagactggactggacttgttagaacctaagagtgatactgttggttaatacctgaaggttactggaaaagatttgggatcaaccaaagtgcaagaaaagggagatctcacataaagtaattaaaagcagtggtctaagaaaaataaggctattttatgtttttatcccactcaatccagttcattcaacagactgtttataggcattttatacttagtgtattcataaaacagagctcttaattttcctcctgattttctgtcatggcctgactaacaacccagttgcacaagccaaaatcataggagttttctttgactcctctctttttttctatctccacatcatatttatgagcaagtcctgttgactgttcctccaaaacaagttccaagtcttcttattttacttcttgtaaaatccaaattcatccaaattcctgtggcctgcaaggtcctacatgttatgtttcctttttgaccatattttctgttactcctctgctgattcactgtgcttcagccacactttacttgactataccaaacttatttctgcctctggacgtttgcatttgttttatctgttttcaatgctcttccactagatctttgaaaatcttgcttctttttcattagtcagatctctactcaaatgtcacctcctcagagaggcccttcctgactactacactgaaagtatcctctacctcctgcctcatcactttctagcagaccactatcttttatatttataacaacttgaaattttcttatttatttctttatgtgcttaatgtcttgagaatatgatctccattatctgtcttgtttgctactgcacctccagtgcataagacagttcctagaatatagtaggaactctagttgaatgaatgaatgaattgaatgattgccagaaatcttgcctcagagcaaccataaggttaggctgatgttggcagcaagcaaatactactttttgtcagtaattacaggggcatgcttctccactgtgaccttgactctaacttttggaataacaggttttctggagtactatccccaagtaacctttggcggacatctcattcttacaggtctgctaggtcctaccatccaggctgaggtttatgatacagtggtcattacacttaagaacatggcttcccatcctgtcagtcttcatgctgttggtgtatcctactggaaagcttctgagggtgagtaaaataccctcctattgtcctgtcattctatgaatagaacagtgagatgtgtgtgctttgtaatggtggcgttacaactcttttaaggtcctaactgaacattatgtgtatttcttaacatttactagattataaatatctcaagatagggaaatccatcttatttattgctgtgtccttagcatataacatattgcctaccctatagtagatactcaatacaagaatgagggtgtagtggacaccagtcattttttcttcctaaaattaaacatttctcacctgtataccccctaggaattgcttttctgaatatacttcaaacagaacctgccattttcttaaagcccatgcctccctagccatagcagttgatctaggagtgagcagttgacacgggtatcccacctccttggccacagttgattggtccagagatgggcaccttacccaagctaggccaatgagagtacttgcactagcattttgaaatttatgagaaaaaggacctattattaccaggtaatcctatacttaggggatggagcccaaatataataaaatcaagattctactacttcatgtatatcatgtgggccatggatcttataggagtcttaagggggtgttggtcttgtccttttcttagttgcctagctctttgcaggcatggtgcaaaggcaggacaatctacctttatctgctccttctataccactgatcctaccctaaacatgtagctgtataatcagagacaggaagccatggcaaatctggagggtctcggcttggctatatcttaaagagttacatgtattcgtagttcaacattggggaaattttccaaaaattggtggagaaacgagtggccaatgcaattttatctttttttttctgctgacatcagggagagataagagctttaaaatcacaattatggggagataatattttaaaatccagctcaagttaaacccatcagaaaaggtaacaccttttgggacccccaaatggccacatcttatccaatgaggggacaccaaccatagagtctatactgcacagttcaaatggtagccatgagctatcaggcacttgaaatgtggtgagtcctacttgagacatactgtaaaatatacaccagatttcaaaggttaagtacaaaaaagactaaaaatatctcattcattgtttataagtacaagttgaaatgcttatatttggatatactaggttaaacgaaatacattattaaaataatttcacctgtttctttttacttttcttaatgtgactaccagaaaatttaaaattacatatgtggtttgcattatatttctattgaacagtgaaatgtttagcatatgttgaagttgctgctcctgatgcagtggctcatctcagatttggccaagttcttctgtccaaggaaaactaggttcaacccattcctggagaggaacagactcaaatctttctgggctgggtcacttaccttggttaaatctgttctccacctattctaccaacaaccaaagggatggacatagctgaaataaaaatcacgcaatcacactgaatggtatctcacctcaggtgggccttcagcattgcctagccattctactgctacatttcccctaatccatttactctccctctccccaagacagctataatgtttcacacattgttagcctctcattgaacctccaacatgtgctcccgcccctgcccccaccacaacgtgagccttgggaaaaagggtatttttttcctaatgaaatatttcaaacaaagataaatacagaaaataatataacaaacaaacatgtgcccatcacctcactttgccaaatcttaacattttgtcatctttgcttaatttattttacaaaattaagcattttacatacagtctgtactcctctatggggctggcaggaaaaggctctcattgtcaaagttcaaagtaattgatcattgaaaaaataatgatcacattaaaaacaacacttatataatagagatacatattgtaatactcataaatgaaatgatatcctgtctaggattggcttcaaacacatccaagctgatgttacaatcattaggtgaattcctgatgtggaatttgacatttgtatggcgccaaaataatatcccagtgatttttttctgattgtaagtggaaatgttaactttagaatggaggtatcaggctaatccacaggtcagttttagtgtcactaaggatgggatggccagatattatctgcccctgatatggcacaatatgagggactcagcatcatctttgatatattttagccaaaaaacttatttaatttgaatctaatcagaacttaggcatattcaatagcatgggatattctacaggactacaagccaaatttctttcaccaaatgagtgtcagaaaaaaagggactactccatactaaaagagactatgggcctaaacaaccagatgcaatctgcagtcttaggttggattctgatttggaccaactagctacaaaggatgcctttgaggcaattaagaaaatttgaatattgcattgatattaggtgatattaactggatcaggtgtgctagtgtcattttgtttatgtgggcaatttttttttaaagatgacttctaaagtatataggagtggactatcatgaaatttgtaatgtacattaaaatgcatcatcataaaaagtgtgttgaaagaaaaaagtgaaagtagcagtgcaattctaagaataattttctaacatccactcacaaaaatattaaattctttatattaaacacatgaaaaagaacacaaatatatctgtctttcaagattcatctcaaattccacctccttcatcaagcattactgaagagtaggaagcttgtttactttttttatccactgtgttgctcgctccaagggcatagagacttctatcttgatctttatattttcagcttgtagctgagtctggtaaagaataagaactcaataaatatttgtgaataaataggtgaatatttccacatggtattataattatatctttatatgtctatgtcccccaccaaacatagtgttgtaccactaggaaagaacaaagtttaagaaattttcttaaatctctctttcttactgttccgtgaccctcactagtgcctaccaaagagtctgtgacaaagtgtatttgttgttgaattgaattaggcaaaaagatgcaataatggaagcaatttattatttaacagaatgtggagatatcaaccagaacctagtttttactgctcatgctagggttagtgatctcaagatcctctggagtatatgaagcttctccccatttgtggctgctgcttgttagtttttcaaattaagatgcagaaagtaggccgggtgtggtggttcgcgcctgtaatcccagcactttgggaggctgaggcgggtggatcacaaggtcaggagtttaagaccatcctgaccaacatgatgaaaccccatctctactaaaaatacaaaattagccgggcatggtggcacgtgcctgtaatcccagctgctggggagtctgaggcaggaaaatcacttgaacctgggaggcggacgttgctgtgagccgagatccagcctgggcaacagagtgagactccgtctcaaaacaacaacaacaacaacaacaaagatgcagaaagtccgtttcttatgtagaacctattggtgacaataaacttgacatgtttctttgagtgtacagtggatatagaaaggacaattttatttcttcctgctataggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaaggtaagtgtatgaaagcgtaggattgagatgaaataagcagagaagtacaaacaactgaatctatctataacagttagcatttgtgttccttcacctgaaagaggcttttttactctagcatcatgctcatggaaaggagaataatccagtttctgagagaagcagatatgcattctatataaccacaataaactctaagctgggatcaggaggagctgagttccagaattaaatctctctcctcaaagcattgctattttcctcttcaaatctgtgggctttatcagtagtgatttctactgtcctctgccttttgcaaactttgagctaggttccttgaaaacttcatggaggtaaacacatccaagtgtgtgatcaatggcatatagactggttcaggtggttagtttgtcatctgtaaaccaaaagtatataaaaatctaagaaaagtcagcatttatttatatgttactgaaaattaattaatttggattgaattaatatattctaaaataattctaatcaaacctgtttttaatttataccttagcataaattagggaagtaaattttgcataatttgtttttatcctattttttatggtgaaatcagcttcactgtaccttttccttgttccatttatcttttactgcataactccacaatttagtggcttaaaacaacaacagtctcttattatctctcatggtttctgtgagtctcatggaatttgtcagtgttttgacttggtggcctatctaagtgtgtctcatgaggctgtagtcaaacagtggctagagctgaaatcatcccaaaggtgactttattcacatgtctttgaccttggcttgatggtactctccacatgatctctctcacatgggttttacagggtagccagacttcttatatggtcctgagatagcccattagaagctgtttcacgatttctaatgtaaccttggaaatcactcacataacctacattctattagttagaatgcatcactaagaccagtctataaagggagactccaccttttgatggggaataggcaaagaatttattaacaggaatcaccatactctttctgaatggtgatgatgaatgtgattcaaaaaaaggatgggagcggggagtggagaagatgagaaaggtttgtagtttataatagtttcagatgaaagtatgatttctcatatactgagttcagtttcatagtcataattaatgagaaagtgccaaaaccacagtgtattatttatgggatgtaaaggctaatggaacaatgagatcatcaaaacattagtgtttacatatgacatataaagaaataagttaaaaacccaaatgattctttgacacagagttgaactaaagagtctacagaggttctagttccaggtgaaatggataaacacactccaccctttatttcccattgaacttaactataaaaccttgacaaaatgcaaagcccagatatttaaaaatttctaaaaagcaaatagaacaagtatatagagaaaagacactagaattgaaagtattaccaaacttgtgggggagtatacctttttccccactctagtattccttaacctgaattaaaacataactggagacttcgaagtgagtactatgttgcaaagagagctccaggacaaaccctctggggtttcaaggagtgagaaaggtaactctaaatgctcagagagcgtgggaggggaaatcccctagggtttttgtcctcttttccaccattctctcaagcttcagtcccaggttgcctgtggcaatgacagtggctggcaacagaaacctgccggagtaaaaacttagggaggggaacattattcttcattcagtacagctacagatctaagacattgggggaaaagcacattactttctctctgtctttccccttccattgcttgaccttagctatgatgtagttgtggaaattggaagcttctggttagaaaaccaaaaaagggagctcacagaactggaaagtttatagatgacagagagaaaagatcccaggaaagtaaacccataaagttgtgcattaactcctggattcacccccaacctacacatccaggtatgtagtttcagtgtcagatctgttttaaaccccttgcagtgccattgagtccaacgcagtggccagtctggtgcttgaggggaaatctcagtttcacagtcttcaacatgttccattagcctttacgtcccataaataacacactgtggttttggcactttctcattaattatgactatgaaactgaactcagtatatgagaaatcatactttcatctgaaactaacgcccacagaattccttaaaacatgtctgatggctgaaagcaaagatagaacattgtgagataggttttttaatgtatggtagatacaatacataaaagaatcatagcataacaagaggagggtaaggaaaactttatggtccattcaacttcattccaattcaaatggtaaaatgttgactctaagtagatgatagtgaaaggttaagtatgtattttgtaatccctagagcaaccaataaaaaattataccaagagacacagtaaaaagtcacaataaactaattacaatggtatatcaaaaatattcaaataactcaaaagaaggcaagtaaggagagatgaaaatcagagagaagaagcagtaaaatcataataaaatgataggcttaaatctaaacatatcaatacttacattaagtgcaaatggctaaaacacaccaattaaaaacagagattagcatactggatataaaagcttgaaccaattatatgttgtttacaagaaactcatttcaaaaaaatgatataggtaggttaccagcataaagatggaaaaggatatatgatgcaaacatgaatatgaagaaagttgaagtagtacaaatctgtaatcacaacattgatttttgccaggagtgccaaaaccattcaataggggaaagaatagtgtcttcaataaacagtgctgaaacaggtgaatatctgcatgcaaaatactgattgagtatcccttacctgaaatgcttggaaccaagaacgtttcagatttcagatactggaatatttgcacatatataatgagatagcttggggatggaacttaagtctgaatatgaaattcattttggatataaatcccttgccagttatgtgattggcaaatattttctcccactctatagtttgttttttcattcttttaatggtgtcttttataaagcaagagttatatggacaaacatatgaaaagatgttcaacatcattaaccattagggaaatgcaaattcaatcaacagtgatgtatctattagaatagctaaaataataatataaaattgccaagaatcctgtcaagaattcagagcaacagaaagtttcacaatgcacaatggtatagccattctggaaaacagaatggcagttttgctgcttggtagagaaacagtctctggcagtttcttgtgaaattagatgtacactatagagggatagcaggagggagttctttttggatattgaaatggatctgtatcttgacgatgatggggtttcatgagcttatatctttgttaaaagttatagacctatacaccaaaagaaaaagtcaatttcactataattgaaaatttatataaaagtaattagaatgttttaagacagctttatacgtattttaaatgtgtctctaaagtttttaatccagtacttctggtaaagatggcacagggtcttcctacttagccatttttccatcctccacctcaaccccaacctcgctgaaaaccaacaacaaagataggtaaaccataaatagagaaaatcgaataggcatggtcagctgaaaaagaagataaatatttgtggaccagaagcagaacaggaactgtgagtagtaaaaggggtggaaattacaggccaactgagatctgggtcaggaagccagctgcggtagccaaggagtcaggatgacaaggataaatagtgctccccaccagagggactgagagcccatatcatagagttgggctcttcttcacttgaaagagagctgagcacagctgctgctcactctttgtttagggccatggctttgtggaaactcagagtcctagaagaggggaaagcaaacccagtcctagaataggaactgaactaagttttcttggttcagtgggggaatctgcaatatccccaaggtttccattggccagtatctccaaaattccattctagggtatgatttgctagatagagaatagtgaacacatcctttgcttaatcaaccaatgatcacaagggacagcaaagatcactatagttcaacaaagtcagatttattggctcatggcaacaagagactgtggacacctccctaaacaaagggaaatactgtatagagttagtaaagaattttggggaagggtggaggttaggtgatatttaaatgaagcaaagtagagttgtgtgtaaagaaataaccatgaggtctagactgtgaagtgttctaaaaagttaacatagacatgaaaggttaagtcaaggcaccccttacctgaagcttgagctttaaattgagctgcttctttgtgtcaaagtaatttagatgacctaggaaagaatgagatgtttcattcttgttgctattagttcaaacatttctggcaggctgtgaattcagagaacaaacaactcaattgagtaagaaagcaagagataatcaaagcaaatagttggcattcagtgagtttatacagtggcaatgtgtccttgggagaaatggtgttgttaactctgcagttagctttatctatgtctcttatcccagcctgatgagtagcagcacacgtactgttgctttcttagtccaagctaatttttatttctaagcattaagggtgcgagagagagaaagaacggcaaaatgtcataaacaaaaatctttctactcaaaataagcctgtaaacaaaagtttccagtcaaatttaaaaaatatataattctaagaaagatagccaacaagctcaacagttaaagcatgaaacaagctagtttgttccattaaaaacttcagctatcgatatacacggtatttatttaaaatgtgagtataattagaagcactgtgggctattgaaaaaaaatcatgagtatagatgtttaatatggacaattgctattttactcaaaacttttaatttacaattgcagaagtataaaaagttacaagagtaacagaaattatctataatttcactattatcacacagtgtgtgagggcttgtattttgtaagtgtttttaatttttttctttagtaattcatttttatcatattttacacaagtagtggtcttcatcaaagttgaaataaaaaaattctttgctccagatagttttagaaacactgctataggagacctgacatcaaagccaagttatcaagagacagaagactacatttgttcttactgtcaagtaactgatgaagaactgtctcctcctagtgacaatttcctacaatgagattttttaaatagaagataaatgttctcacttctttttcagggagtctggccaaggaaaagacacagaccttgcacaaatttatactactttttgctgtatttgatgaaggttagtgagtcttaatctgaattttggattcctgaaagaaatcctctgctactattaagaggaggtgattatagaaagatcataaattacattactgttcaggaatgaaggagatggggttaaaaatgaattccaagaaaacaaaacgtaacctcagttccactggcagctatgaggtaagaagatagaggagctggataacggactggcctcatccccctcattaagactgtcaacaaatactttgggctctactttctaaatactttctcttatcttcatctattattaagtgcacaacctttggcaagttatttaacctctctgtgtctcggtttcctaaatggaaataatagtacatttttcataagattgttgtgagtgctgagtgatttcacttaagtaacctagagcactgtgtggcatagagtaggccctcaatagtgttagtacctccgcctcttcctcctcctcctaatgtaatcactatgtaatcatagtaacataatattcttcttgcccccttatcaatttacattgccatcttcttaattgaggccctcatgatctgtctcataactctcaaaggaagcttactgaagtgagtatctgatcttgtcactctagcctctacaatacttcagtttgccagtttcggtggctcatgcctgtaatcccagcactttaggaggctgaggtgggcagattgcttgagcccaggagtttgagaccagcctgggcaacagggcgaaaccacatctctacaaaagaattaaaaaatcagccggtcatggtggcgggtacctgtactccagctacttgggaggctgaggtgggaggatcacttgagcccaggaggtgaaggttgcagtgagctgtgattgcgccactgcactccagcctgggtgataaagccagaccctatctcaaacaacaaaacaaataaaataattcaatttcaaggtaaagtgcaaaatgcattatctattctctggtgacatttccagccttgttgtgttccatttcctgccttatcttccatgtcacccaaatatgtaatgctttttcttgcatgagacctctgcatatgcagtttcctctgcctggaaaaatctgtctccctctttacactaagtaagcttctcctttttctttaagtctgacttacttcagttatccccttccttaattccttctcccaggatgacctctagtctggattagatgcctgcttatatttccacagcatcttgagcttattccttatcatactatatcagtattttctactttatttaatatttatcttctttgatctcatatctttttcccttcaagcaaagtgaaatttcttctcctctctgctccctgtaacaccctactctcatctttattatatcactctttactctttattataattatcagcttctctgacgattccagctagagtgtaagcatcttgaaagcagaggctgtatcttcctctctatcatcagtgtctacaattagtagtgctcaataaatatgtgtttgaatgaatgaacaaatgaatggctgcctcataaagttttagcactagctaccagtccttcacacaaaggggtaactccagggagtcactgttcaatagtatttccagtgcttcagcccttatcaatttcagagacagtgttagggagctttcaggttcctggggtttcataaatataagctgggatgaagcaattataacggagacagggactgacagacagcctttttcctaggacaattttcttttttcttttcttttttttttgagatcgagtctcactctgttgcccaggttggagtgcagtggcacaatcttggctcactgcaacgtccacctcccaggttcaagtgattctcctgcctcagcctcctgagtagctgagattacaggcacatgccaccatgcccgcctaatttgtgtatttttagtggggatagggtttcaccatgttggccaggctactctcaaacgcctgacctgaagtgatccacctgcctcagcctcccagagtgctacgattacaggtgtgagccaccgcgcccggcccctaggatgattttcataagctttcttttaaataattcagctaataaaaagaattgaatcctgatgcctcaagctaaccaatattctgtcttctattattatccattcccacttattgtcatggacaaatggagggagagaaaatcagtttgagcaagagatgtctgcctttacataattatcttctccctccctcacactgactttgagaggataagtgctgtgtgcctactttgctgacaaaaatgcttaaggtgtgagcacactgggagcagggaaggagaaaggggaggcggtcattcatgagacacatgcttagctgactctatctttgccttctctctcatcagggaaaagttggcactcagaaacaaagaactccttgatgcaggatagggatgctgcatctgctcgggcctggcctaaaatgcacacagtcaatggttatgtaaacaggtctctgccaggtatgtacacacctgctcaacaatcctcagggtcttccaaattcagcaccagagttctgtacttcagttcacaaacagctcggcatctcagaggatatagcccactgaatacttgaagatctctggcctctggggatcttaatgtatagtaggcaattcctcttttggtcacctgaaaatgaaggcttacccatgtacatacagcccacagtcagatttttctttccttttcttaaatgtgagtgggcaaccaaggatgaacagacatttaaaaagaacctaaaatatggaagggatatgcaaagatgaacaaagaaaataataatcccagaataaaaaaagctatggctcagaacagaactcatcggaagctcttacttctattttcataaagattcaagaagatactgcatcaataaagtaacaataagatgccttccagttttaaaataggggcatagaggcaggctggctttactccctctcacagaaaaccaaaaccaaacatacagcaccaatatctacaccaacaacaacccagagctcacatgtgaggatgagacagttcccggagccacagagaagtgaaaaaactttgagaatcagacttccacatccatgactctccttcctcctattctgcccagcaccaagtgtatggaaaatctcccctcaactcatggtttctacactggaaaaagtgacattgaggtgttcaaccagcttctccaccttcttgggttccctggggggagatttgtccttgccttaacccacagaaaacatcatgactgtctgaaggcagaaatatcccagagtacaggcagagacaaatgagggaggaaggactaccatccccagccctggaaattctgctctataatttggccaaagacatgcaaattcagaatggccgtgcagcagcaccatgctgtagcaggtttatcctacaggtcaccttggcatgaatcactagctggccttccaacactgctatgataatccctttgggacctcacccacttgggacaggcagggctctgaccacttactggaacacctgtaatcccagcacttgagctcagcacaataacaataggagatggctactaccgttaattttatgcagttacgatttaatactggatctttacgtttgtttacatttgtcccaactggcaccttcatcacctccaccctccccaccccagactatggtaaccacgattctactctctattttcacaagatccactcttttagctcccacatgtgagtgagaacatgtggtattgccctgcagtgtcacctatgttgatgcaaatgaaaatattcttttttatggccaaatagtattccattatgtatatataccactgaactgtacacttaaaaatggtaatgatggcaaattacatatgtatattttacatcaataaaaagaaacttaaaaataaggtaacaataggattctatgaaaaacaatcataacaaaacgtgctcataaaaattataaacacaatggtcaaaatagaaactcaatagaaagtactaagaatagataaaatctttcataaggtcaaacaaaatgtggttgagaatatagttgacccttgaacaatgtgggggttggggtactaaccccctgcacagtcaaaaatccatgtataacttttgactccctccaaattcaagtactaatgacctattgttgatcagaagccttatcaataacataaacaacaaatattttgtgtatgtattatatgctgtatattttcaataaagtaagctagagaaaggaaaatgttatttatacttttctctgcttcttgggagtacttccagcatcactagtggcactttatacgggtcccaagtatccttcaaagtttatggagagatgaaatgcttatgcagagatgattagcatcatgcagagttttcagtggatgcctgcagcactcgagctcagcacaataacaataggagatggctactaccgttaattttatgcagttgcgatttaatactggatctttacgtttgtttacatttgtcccaactgggaatggtgccatgtatggttgtaagtatgtaagtttttataaatttcaactttttataatagatttttgtatattttatggtaataaatgataaaatagtctagtatcaacatgtatatgtatatataagtgtgtatacatatatatatatattttttttttttttttttttgagacggagtcttgctgtcgcccaggctggagtgcagtggcgcaatctcagctcactgcaggctctgccccccggggttcacgccattctcctgcctcagcctcccgagtagctgggactacaggcgcccgccacctcgactggctaattttttgtatttttagtagagacggggtttcattgtgttagccaggatggtctcgatctcctgacctcgtgatccacccgccttggcctcccaaagtatatatatatattttttgagacggagtcttgttctgtcacccaggctggagtgcagtggcacaatctgagctcactgcaacttccccctcttgggttcaagcgattctcctgccccagcctcccaagtagctgggattacaggcatgtgccaccacgcccacctaatttttgtagttttagtagagatggggtttcaccatgtttgccaggccggtcttgaactcctgacctcgtgatctgcccgccttggcctcccaaagtgctgggattataagtgtgagccactgcatccggccatctccatatattttttgcattcataacatacctttttcttaatttttttgatatttttaccctatgtggtccatctgacagttttttcaaattgtcataaatttccaaaaaaatctcactatatttattgaaaaaaaactgcatataagtggactcatgcagttcaaacctgtattgttcaagagtcaactgtgtgttttaaagcagattttaacatcaagaaatgatagaaaaatgataagaattaaaagagataaatattcatattagaattgcccatcaggagcttctgagtagctgaacgcatggaggttcctggagagtggctggccccatgccccttcccacatacccttccttatatatgcatctcttccatctggcgtttataagaaaaggtgctgactgctgaattataaggacactgtggtctactagataaaggttgaggagaggggtttgggcttctattgtcttctttccgggccttcatctcctgcttgtgattaagtagtgcatgctgagtggagcaaagtggtggaataggactcttcagcaataatctcctcacagaaacatcaaggtaacaactcgatgcgtgaaattaccttcagaagagttaagaaaacctgaacccatgagcaagactgtgaagcccttttggactgcaaagacgagtaaaaccatagttgcacataaaggggattggttctttatgactgagaccccacccgcaagccactgcagtaccacaggcggaaagtcaccatggacccacggtttttacaccggaaaactctcccgtatggcctgagtgccctctgtggatctccactaattagtagcagagccagcatgagacttgcgtctaacctgggctcagggcgccctctcgtgctaaaaggaaatacaacagccagtcctttcactttctttttgatatggtctctgttgcctaggttggagtgcagtggtgcgatcatagattactgcagtcttgaactcctggctgggctcacacggtcttcccacctcagcctccagagtgggactacaggtgtgtgccactatgcctggctaaattttcgggttttgtgtgtggggtggggaagattggggtattgctatgttgctcaggctgggtctcgaactcctgacctaaagcaatcctccagcctcagcctcctaaagtgctaggttacaagtatgagccaccacactcagccccactcaatttctaaacgagctcactgaaatagagcagtcacaaacaaacccagactgtgaacatgagaataaatacctaattcttcaatgtgtagacagggatgcacatctgcaaagaataagaatagcctaagaaagacagcctcaacaaatgaacaaaaaatcgtgccagtgactaatcctaaagacatgcaggtgaatgatctggtagacaaagaattcaaaatagctattttaagaaaactcaacaaacttttataaaacacagagaaacaattcagaagtttatcaaagaaatttaacagagaaattgaaggaataaaaaaagtcagaaatcctggaactgaaaagtataataaaaaatgacacatgcaatacaagacatcagcaacagaattgatcaggcagaagaaaggatcagcaagctcaaagacaggttatccaaaaatacaatcaggaggggcttcaggatggttgactagatgcatctagtgttcatcccttccatggagaggaaccaaagtagcaagtagataattatactttgaataggtcatctaagagagaacactggaattcaacagagcagtgacaggaagcattgaaagcaagggaggagagagaaataaggcctgtttgcctgggattggctgggagtctggaacagcttcctaatgtggggaaaaggtaagagacccttagtgttcctcattttcaccaaggactcttgcaatcctagccacaggagagcgccttattccttgacagcacagagactagcatagggagttgcctaaagaccgtgtgaaggcattgcaacagagagctcacgctggattctgcaattctcccaagcagctgcagcacagcaccattttgagaacacagcccacacatcctgccctgctatgatggccgtgacttaggcaggagccctgagcagtgatcctgccccacccagcagaggagtgcccatgcattttcacatattccaagaacaaattccactacctacaaccactgctgctgcaggctgctgtggggccaaaacactagtgaaccttgtgctcccaagctacctgcctacagctactccctgagaaagcaaccccaccttcaccaagagcagggctatagcacagctactgctgcaccccaacctgagcattttgctagtgacctcggtatcaccccacccctgcatagcacaaccagcacctcacacaccaccaaggagcctgagggcaggttcacgtagcccagctctacctgcccccagtacccaagcatatcatccaggggcctagggatcacttagccctgtccaccactggtggcacctgagcacctcctggggtctgaggtcaggcccactcaacctgccactactgccacagttagcactcactgcatgcaccacttgagggtctggagactggccatgcgatccatagcagccacaaccaacgccagcacagaccacttgagattcaggttgtttcattgctatgattgccatcaaccatgccactttgctgcccaggaacttgagaacccacccacccatgtgatccatcaataccacttctggcacccaagtaaaccacttggaggcccacaaatcaacctgcctggacctaaaaccagtgcaatcatatgccaccatggtacaccaaagacaagcacactcagcccactgctgccaccattggggcctgaagacaggcctacctggcatcccacttctcagaaaaacttcaccacagcctccactaataaccacaccctaagccactgagaaaatcacaaatatcactgatgctgtttagaatcttatacagaggctactacattcaccgagaatcaaaaccgaagtgctctacccaagcaacaccacagatacatcttcaggaaaaagttctttcctacaaaagcaaattttaaaaattggaaaaagtgattattacaccagatgtgcagatatcaatgtaaggacacaggaaacatgaaaaatcaaggaactatgacactccaaaggagcacaataattctgtagcaagagatccaaataaaaaaaatttaagatgggtacaaaaaaatagaaagaatgaataagacctgctatttgatagcacaacatggtgactatagttaataataacttaattgtacattctaaaataaagagtgtaattggattgttaataactcaaaggataagtgcttgagggtatacatacctcattctccatgatgtgtttgtttcacatcacatgcctgtatcaaaacatctcatgtgttccataaatatatacacctactatgtatccacaaaataaaaaaatcatagtttacaagcaaaacagtatatgtgaccattggtttttaagtaaactggccaacatctctttaaaaatttatgaaatcctggaaaaataattccaaattttgatactaaataaactcagtgagatacaagagaattctgaaaaaaatacaaagaacacagaaaaacaattgaggctatgaaagagaaatttacccaagagatagatatcaaaaaagaaccaaacaaaaattctggaaccaaagaattcattgaatgaaatacaaaatagatttgaaaggttcaacaatagaccggaccaagcagaagagtatcagaactgaaatacagatcttttgaaataacccaatcagacaaaaataaagaaaaaagaattttaaaaaatgagcaaagatttcatgacatattaggcactataaagtgaccaaatatttgaatcttcagtgtcccagaaggcaaagagaaaatgaagaggttagaaagcctatttaatgaaatattagatgaaaaatttccaagtctaccaagagatttagacatctagataaagaaggctcaaaaatacccaaataaatacaatgcaaaaaggtcttctccagggcacattatagtcaaactatcaaaagtcaaagaaaaaaatttaaaaatagcaagagaaaagcatatagtcacctgtaaaggagccgctatcagactaactgtgaatttctcagcagaaactttacaagccaggagagaatgagagagagagaaaaaaaaaaaaaaacacctgccagccaaggatactgtacacagcaaaattatccttcataaatgaaagagagagaaaaatattttcagacaaaaaaaaactgaggaaattcattgcaacctgatctgctttacaggaaatgctaaagggagtttttcaaactgaaagaaaaaggtcctaatgtgtaacatgaaaacatctgaaggtataaaacccacaggtaaaagtaagtatcccgacaaattcagaattctctaacatggtaattgtagaacataaatcacttatatccttagtaggaagattaaaaaacaaaacagataaaaataattaccataacctgttaaagaataagcaatataaaaagatgtaaatgatgacatcaaaaacacaaaatttgggagtcgattttttaaaaaattttcttgcaatcaaaattaagttgttatcagttcaaactaacttgttataactataaggtattctgtgtaagcctcatggtaattacaaagcaaaaatttttataatagatacactaaaaataaaaagcaagggattaaaacatactgatagaagaatcacttaaccacaagggaagagattaagagaggaagaaaggaacaaaggatctacacaacaactagaaaacaagtaaaaatatggcactaccaagttcttacctatcaaaaattaccttgaatacaaatgggttaaattctccaactaaaagacatagagtgtttggttttttgttcttgcgatagtttactgagaatgatgatttccaatttcctccatgtccctacaaaggacatgaactcatcattttttatggctgcatagtattccatggtgtatatgtgccacattttcttaatccagtctatcattgttggacatttggaccgcatattctcactcataggtgggaattgaacaatgagatcacatggacacaggaaggggaatatcacactctgggaactgttgtggggtggggggaagggggagggatagcattaggagatatacctaatgctagatgacgagttagtgggtgcagtgcaccagcatggcacatgtatacatatgtaactaacctgcacaatgtgcacatgtaccctaaaacttaaagtataataaaaataaaaataaaaaaatttaaaaaaagacatagggtggctgaatgaatttttttttaaaaaaagatctaactacatactgcctaagagaaagactttacctgtaaggacacacatagactgaaagcgaagggatagaaacagatattccatgcacatgtaaacaaaaagaaagcaggaatagctatacttatatctgataaaatagacttcaagtcaaaaactataaaaagagacaaacagccagacgtggtggctcatgcctgtaatttcagcactttgggaggctgaggcgggtggatcacctgaagtcagaagttcgagaccagcctggccaaatggcgaaactccatctctactaaaaatacaaaaattaaccaagcatggtggcaggcgcctgtagtcccagctactcgggaggctgaggcaggagaatggcatgaacccgggaggcggagcttgcagtgagccgacattgcaccgctgcactccagcctgggcacacagcgagaatctgtcaaaaaaaaattgacaaacaaggccattatataatagtaaagaagttaatacaacaggagaatgtaacaagcataaatatatatacacccaacattggagcacctaaatatattaatgtttgatctttgtattttctagtctcattaaaagtaagggcaaaaactacaattacttttgcaccaacctaatataaagcaaacattaatagaccaagggggaaatgaagacagcaatgaaataatagtagaaaactttaacaccccactttcaccaatggacagatcatccagacaaaatatcaacaaagaaacactggacttgaactgcactgtagaccaaatagagcaaacagacatttacggaacattccatccaacagctacacagttcacattcttctcaactgcacatggaacattctccaggagattatacattaggccacaaagcaagtcttaactaacttttttaaaatgaagtatttttttcctgccaataatggaataaaactataaatcaacaacaggaggaacaactgtacaaatacatggaaattaaagaacatgcccctaaacaaacaatgggtcaatgaagaaattaaaggagaagttaaaaaatttcttgaaacaaatgaaaatggaaacataacatgccaaaacttatgggatacagcaaaagtagtccttaaagaaaagtttatagcaataaatgcctacatcaaaaaaaaatctcaaataaacaacctaatgatgcatctcatggaactagaaaaacaagaacaaacaaaaccccaaattattagaagaaatgaatgaatacagatgagagcacaaataatcaaaatagaaactaaaaaatacaaaagatcagtataatgagttagttagttctttgaaaagataaaaaaaagtcaataaacttttagccagactaagtgataataaagaagaaaaacagaaataaatcagacatgaaaaaggagacattacaactgataacacagaaatacaaagaattataagaaactactatgaacaactataagccaacaaattgaaaagcctagaagaaatggataaattcctggacacatacaacctaccaaggttgaatcaagaaaaaatggaaattttgaacaaatcaacaatgagcaacaagattgaagcaaaaatacaaagtctcccatcaaagaaaagttcagtacccaatggcttcactgctgaattctaccaaacatctaaagaactaataccaattcttcacaaactattcaaaaaattgaaaaggaagaaactcttccaaaattattttaggaggataatgatcattatcctgatcccaaaaccagacaaaagcacaataacaacaaacaactacaggccaatatcctcaacaaaatactagaaatagaattcaacagcacattaaaagatcatttaccatgatcaggtgggatttatcccagtgatgtaaggatggtttaacatatgcaaattaagaatgaaggacaaaaattatattatcattttaatagacacagtaaaggcatttgacaaaattcaatatcccttcatgataaaaactctcaacaaagtatagaaggagcatacctatatgataaacctacaaacaagatgaaactgagtggggaaaagttgaaagcttttcctttaagaactggaataagacaagcatatccaccctcaccacttctattcaacacagtactggaagtcctagccagagcaattaggcaagacatccaaattggaaagaaggaagtcaaattgtccctgtttggccaggctcaatggcttatgcctgtaatcccagaactttgggaggccaaggcgggcagatcacttgatgtccagagttcgagaccagcctggcaatatggtgaaaccccatctctactaaaaatacacacacacacacacacacacacacatgctagccagacatggtggtgcgctcctgtagtcccagctactcgagaggctgaagcaggagaatcactagaaccccagaggcggagcttgtggtgagccaagatcgcaccactgcactgcagcctgggcaacagagtgaaacactgtctcgaaacaaaaacaaaaacaaacaaaacaaattgtccctgtttgcagaagacatgatcttatatatagaaaactgccaaaactacaccaaaaaactgttagagctagtaaatgaatgtagtaaacttgtagtctacaaaatcaacatacaataattgatagcatgtctatatgccaacagtgaacaatctgaaaaagcaatcaagaaagcaatcacgtttacaatagctacaaaaaatgtccagaaataaattaaccaaggaagtgaaagatctctataatgaaaactataaaatattgatgaaagaaattgaataagacacaaataaatggaaagatatttcatgttcatggattgaagaattaatattattaaagccaaagcaatctacagattcaatgcaattcctatcaaaattccaatgtcattcttcacagaaatagaaaaacaatcctaagatttgtgtggaaccacaaaaaatcccaaagagccaaagaagtcttgagcaaaaagaataaacctggaggcatcacactacctgatttcaaattatactacaaagttatagtaaccaaaacagcattgtgttgacataaaaacagacatatagaccaatagaacaaaatagagagcccagaaatacacccaaacatttaaagccaactgattttctacgaagttggcaagaatacatgatgggtaaagaacagtcttttcaataaatggtgctgggaaaactggatatccatatgcaaaagaatgaacctagaccccctatctctcaccacgtatgaaagtcaaataggccaggcacagtggctcatgcctgtaatcccagcactttgggaggccaaggcaggcagatcacttggggtcaggagtttgagaccggcctggccaacatggtgaaaccccgtctttactaaaaatacaaaattagccaggtgtggtggcacacctgtagtcccagcaacttgggaggctgaggcaggagaatcacttgaaccccagaggtggaggctgcagtgagcctagatcgtgctattgcactccagcctgggcaacagagtgagactctgtctcaaaaaaaaaaaaaaaaaaaaaaaaaagaaagacagaaagaaaagaaaagaacaatagattaaggaattaaatttaagacctgaaactctgaaattattagaagaaaacatagtgtaagcatttcatgacatcaatttgggcaagaatttgttagacaagacctcaaaatcatgagtaacaaaagcaaaaataaagaaattggattacatcaaactagaaagcttctgcacagcaaaggaaacaatcaacagagtgaagagacaacctatagaatgggagaaaatatttgcagattatacatctgacaagggattgatatctagaatatataaggaactcaaacaactcaatagcaaaagtccaaataatcctattaaaaatgaacaaaagacctgaatagacatttctccaaaagagacctacaaatggccaacaggtatatgaaaaatgctcaacatcactaaccatcaggaaaattaaaatcaaaactacaatgagatatcacttacccctgttagaatgactattataaaaaagacaaaataacaagtgctagcaaggatgtggagacaaagaaacccttatacactgttggtgggaatataaattagttaagccattagagataatggtatagagatgcctcaaaaattaaaaatagatctatcatattttctagcaatcccactactgggtatataccaaaaagaaatgaaatcagcatgttgaagaaacatctgcatccccatgtttatgacagcattattcacaatagtcaagatataaaatcaacttaaatgcccatcaatggatgaatggataaagaaactgtgatatagatacacaatggaatactattcatccatttaaaaaagatgaaatcctgtcattttcaacaacgtggatgagcctggaggacattatgttaagtgaaataagccaggcagagaaagacaaatactccatgatctcagtcctatgtacaatctttaaaatttgatctcatagtagttgagattagtgattctaggaagataagggggaagtgggagatggggagagattggtcaatgggtacaatgttacaggtagatagaaggaataagttctggtactctattgcacagtagggtgacaatagccaacaataatatattgtatatttcaaatagaagagaggattttgaatggtctcacaacaaagaaatgacaaacatttaaggtgatggatatgataattaccctgatttgaataattacacaatgtatacatgtattgaaacatcacattgtacccataaatttgtagaattatttatgtgtcaataaaaagtaatacagttaaaaaaataaaattgcccattaggataaataaaaagacccacacacaaaattatcattgtggcatttcagagcacagagagaagatacttaaagcttcttctgagaggaacaggacgcatacaaaagaatgggaattagactggcgatataattaagcaatattgtaaaagatctaagggaaaaattatttggaacctagaatttttagtcaaactatgaatcaattttgggggaagaaaaaagacattttcatatatagagggccttaatagtcactgaatgtgtactatagtaaaaccagaaactacataaaagaggaatttgggagattcagcaacccaagagaataatgaagtatgagggggatgttttctccttagttcttttccgtatttttcaataatttgataataaacatgcataattttataattaaaaaggaaattaattttgacaacatgcaagttcctgttctcacataccttatagtggagggacagattgtagtcaaataagcataataatacatgcaaaattacaaactgagcattactctgaaggaaaattacataattctatgtaagcctataatacaggaatctgacctagactggggaatcagagaaggcttccctaagcaagtaccccttgaacttagctttgaaactgggaaaatgaggcaatgtgagatgaagctgttagaggtattaggaatcaaacctattggggccttctagtccttagtagagagtctggactttattctatgtggaatgacagcctccagtgggttttaggctggcggatactacaatcagatctggaatgcagaaatagtacaccagtttctttgtgggtaaaagtcttagaggggagaatatgaccaactgtagggagacctgtaaaaaaagtttatcagtagctcagacgagataatggtaacttggattaagatagtggtagtagtaacagtgaaaaactagatacatttgaaagcttttagagccaaaataggaggcagctgtgcccttgttgttaccagtgtgggatctgaacacatgactacttgggttcaaatactgagcaaattaattaacctctctgggcatccgtttcctctcctgcaagacatggatgataatggtttctacattcatagggttgttatgaggaatgaatgaattaaaacttgtaaaatactttggacagtgcttgacataaaacaagtgctcaatacatattagctattattgattatattgccctggtcagtgtcaaactgcatatgggagatgagaatggtaacaaggataactctcacttgcatattcaaatgcaggatgctgccattcactgttataaaaaactctggaagagaatgaagtgatgaaaattgtaaatttggttttgaacatgtgggttttttgagatatctaggtggagatgttgagaaagtgattggctgtatgagcctggagttccagaagaggtcagcaggggagacagaagaaggagcagtctgagaagtaggagaaaaaaacccacagagatgttggcacagaggccaagggaagagagagttttaaaaacgaatgaatggtcaacaggtgcaaataaagactgaaaaatgtccattggatttagcagcatgatggtgattggtgaccttggcaagagctgttggtttgatagtagcccaatgttcttgataaatttgtttacaagtcaaggtagcaataaagtgtctaaagtcaatttgtccattctgtcctagcaagtgttttccatttcagattctctacttcatagccataggtgtcttattcctactttacaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatggtaatatcttggatctttaaaatgaatattataaatatccagtcctacttttaataaaatttactggacaatgtacaggaatatagtgtgttgctgaaggggacattatagagttactgtattagacctcagccaagatcccctagtttccagcttccagtgtaaagtttttaccttgactataaaagggcttgagtattagtaggactcatggatttttagttaaatgtctgtgatggagaaaagatggcttatggatgattgaggtgggaaaatgaggagaatagtatgcccttggtttctcagccttatcccattaattacgctccaatattatggagagaggaactgcaagttgtagctgaagagattttttttttttttggagaaatctagggaaatgggaaaaaaaggcattgtccagattgcaactgtaagggctccactatatcattagtaatgcccagagcagtaaatagcaaatatgacaggctattgtagagcttgacttcagacaccagacagccagaggcactctgtagatacctggcagtagatgagagacacctgtgaaactgagggcaggtcaggagctagtgaattttagaagtaacatgggattgaaaggactatttggtgggaactttggaaagggtcaaaggttctgtgtaagcaaattaggacgatggtaactacagttttaaattattgttaatgtaactttatttgtaactgctagttgtgcaaattcagattgcatcatcatttcaccccaattttccttacttttgtatttattctgctaactcttaatcttggatcaacctaataaccctctttctctacccctctcgtggccattgaaggctcttagtcagtttgtgctgcaataacagtataccacagaatgggtaatttataatggacagaaatttattggctcacatttctgggggctgggaggtccaatatcaagttgcctttttctgcgtcttaacatggtggaaggcattatatgacaaaagggcaaagaaagggtgagagagagcaagaggagggtgagctcactcctgtgataacaaatccactcccatgaacactttccccagataactgcattagtccattcatgagggtggaacgcttatgacctaaacaccttttatatgttcacctctcaataccatcacgatgataattaaatttcaatatgagtttcggaggggacagacattcaaaccatagcaagagttattggagaaaaatgtcggagaggcctaatcttttatatttaatagcatttctttcttcctattactctcatattaaccttctcctcaggttccttggttgacttagaaaagagaattgatcttgccatgcatccaccattttcctccttatgttctattagtgaccttgtttattgtcttctgtagtgattaagaatagaaatctctcttccccatgtgtcacataatatttatggaattttgacaagaccttagtggacaaaatgtgtcatactgaatgagtaacaggaagttgatgcacaaacaacattcttgcaggcacagaggaataggtcatttacttgtatatgatcattgtcaatcaatcattgtccagttggaccccgattcagtttattttttgttttgtttttctccttttcacagattctatccactaattttaatctttatttttcagaaaaaaatgctttatcttattgaacctcagaccaaacactttgtttttcgatgcagactgagttatgtttaaggctacatgaaccccagactagttgtttgctgctcctaaaaccttccctgttcctcataatcaagtaaacaggtctcccttcttagaagtatttgatcttcaaaattgccctgtggtataaatagggcaggaattattattatccattttacaaagcatgaagatgagactgagaatgttgaatacatttgccatagggtttacaactagtcacaggcagacatgctcttaaaatatatatctccttgattttaagttgtatcttgtcatggttttatgaacttggaacatgtcttaaagtttatatctacactaacatttttcccaataagctgttattaaatcaatgatttgtggcaagaagggatagtgatgtggaaagggggggtacttaggggagagcctggaaggcctaataagagagaaagaagtcataaaagttaaggcaagtgatatggtttggatatttatcttcactgaaatctcatgttgaattgtaatttccaatgctggaggtggggtctggtggcagatgtttggatcatgggggtgaatccctcatggcttgatgctgtcttcatgatatttggtcattcagaagtgtgtggcaacttgcactctctgtcttgctcctgctttcaccatgtgacatgtctcctcccccttcacctacccccatgattgtaagcttcctgagacctccctgaagccaagcagatgccagcaccatgcttcccatatagcctgcagaaacatgagccaattcaatctcttttctttataaattacctagtctctggtatagaacagcctaatatagcaagacactctgacattgtttggtttgtctgactccagatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacaggtaagcactttttgactattggtactctctcttccccatactcaaaaagttcttaccagttattcaaaccaacaaatcctgaagccatgtttaaggttaggtacaggtatggaatcaaatggcaagggtattaacatttggaaactaacatagctgagcatcagagaagcttgtatttttctcactccttgccttgattgaatcatataagctgttttagagttggatttgagcctacctagaatttttcttcccaacctctcatctttttttctcttatacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttggtaagttgaagaaaagatttaaggtcaggtaagaagaaaaagtctggagagttttgagtttctaaaatacctcataattcagccttgtctccaatggacatgatcttttaaaagctataaatgttacacaaataatagctgattgtatgtatttaaagtttgagtatatagaataaaaatttaatgtcacccactaaactcgacactcctttgaaatactgcttagactttgatacatatccttccagatctttctccattaattatgtcatataggagtcagcagactatggcctgtgaaccaaatttggcttgtggcctgcttttgaacagtccatgagcttagatgagattttacatttttaaaatattgcaaagaaaagaaaggaggatgggaggaaggggaggagaaggcggaggagcaagagaatatgtgacagaggctagatagggctcacaaattttagagtacttactatccagccttttccaaaaaatgcttgcttgctcctgatctaggatattaagaatgagtatggtgtaagtaacagaatactcaatggacagtggtttaaataaataagggtttattttcttcacaagaaatttgaagattggtcgttggttccataaattcagccgctgaagaatgtcatgaagaacactggtttttagatatggagttttgttagatactgccaaactgactttcagcaattttgtaccaatttatatcccctaccataagtatatgactgcccttttccccacaccattgccaacaacatatattataaaccttcagaaaattttccaatttgatgagcaaaatgtttatatgttgtcttcatttgcatttccctggttagtggtcaaattgtatattgtttcatgtttgttggctatttgtataactccctctgtgaattgcctgcttgtaaattttgtccagttttctatttggtcagtcatcttttgcttatgtatttgtaaaaggtctttatagattatggatattgacacattgttatttatctttcaaatgttttcctcacattgtcacttgtactttaactcctttatgatattttttgtccttcaaagatttttcatctttatatagtcaaaacctcctatcttttatcaatcttttcatttatatgtctctggatctttttcacttatgttttctgcctgagaatgtctttgccacccccaagacactacaaaaatagtctatattttattctcttacttgtatagctttatttttacagtgagcaatctaattgccctggaagttacttttgaatgtagtgcataattcaaatagaaattttcccaaatggcagctgacacaaccaatccttttttcattaatttgaaaatgtcttctttatcatatactaaattgctaaaatctgggatttttaattctccttaactaatctgttaccaccctgttttaatgacttcaactttgtgatatgtttgatatctgtatgacatcttctttcattgtacttcttcaaaatttttattagctattattgtacaatttttcttcataaattttgtgtacgtattttttctatttttcattttttgaagattgtataattttattttttattcattaatttttaaaatgcataatgacacaataattttacatatttatagggtactttttgtgtattttgagttacttttactggctaatttaaaaatagataaacaagagcatgcaataaaatgtaaattttcctccctcttggacttccaaccccatagtctgacagacagtcattgctgtgggtttgtatactcccctccagaagtagtgcatacatgtacaaatgtgtgtgtgtatgtgtgtgtgtgtgtgcatttcacacaaaaacaagagcagtgtaaattggtctgtaccttgatttttaaaaggtaacaatatattttgaattagccaggcatggtggcacatgcctgtagtcccagctactctggaggctgaggcaggagaatcgctcgaatctgggaggcggaggttgcagtgagctgagatcgcaccactgcactccaccctgggcaacagagtgagactctgtctcaaaaaaaaaaaaagtaacaatatattttggatatcatttcatgtcaacatatatagatctaccccattctttgatttattcaggttatactctggataccatgctgaatcctacacttaaacattacctcaaaatggatcaaagataaaatgtaagagctaaaactacaaaattataagaaaacaacaggataaatctttgtgatcttgaattagacaatagtttattggataggacaccaaaaccaacaagcaacaaaagaaaaaccatttgacccagccatcccattactaggtatatacccaaaggaatataaatcatgctgctataaagacacatgcacacgtatgtttattgcggcactactcacaatagcaaagacttggaaccaacccaaatatccaacaatgatagactgattaagaaaatgtggcacatatacaccatggaatactatgcagccataaaaaatgtccccgtttgcagatgacatgattgtatatctagaaaacaccattgtctcagcccaaaatctccttaagctgataagcaacttcagcaaagtctcaggatacaaaatcaatgtgcaaaaatcacaaacattcttatacaccaataacagacagagagccaaatcatgagtgaactcccattcacaattgcttcaaagagaataaaatacctaggaatccaacttacaagggatatgaaggacctcttcaaggagacctacaaaccactgctcaacgaaataaaagaggacacaaacaaatggaagaacattccatgctcatggataggaagaatgactgggttttaagacaagagcagaagtggaagttgcatttttatcctcatatcacacacctcagatctggaggtgggattgatattttcagggttcttcgctgcagcttccatgttattgctcttccattctctctctctctctctctctctctctcgtctctgtctctctctctctctcttgagatagggtctcattctgtcacccaggctggagtgctgtggtgtgatcacagctcactactgcagcctcaacttcctgggctgaagtgatcctcccacctcagcctcccaagtagctggtactataggcatgcaccaccacgcctagctaatttttttattttttgtagagatgaggtctcactgtgttacccaggctggtcttgaagtcctgggctcaaacgatcctcctgcctcagcctcccaaagtgctggcatgagccactgcacctaggcctttgttttcttttaaagctggtgcaatcaggcaataccacctgctacccttgcttaatactgtaatcaactgtcctcttggtcatgcctgctcatgcactgaagattttatctcctgaaacactgtctctttctctattatcagtgaatttaatgcccaaatagtaataaaggctgagaggaagcagtgtcctcaccaggcatctaaatttcaattagtgtgagaaggtgcagagaatacttcctgaagcaattgaaacaatttttaaagaagtggaaaggggcctttagagagaaacctaagtactgtcagccctctacattgtcaactgaagaatcctaagtttgtaaatttggagtggaaagggttgcaggctgggaagtgtagcctctggcagcaaatggaagcaagcactttgaagaaggaaggatgagataagaatttatgctgaatgagttggctaagtatacatatttaacaggttccaggaggagctgtgaatatttatgatggggcacctgcaaccacacatgttacatacattccatgttcactttggggtggagacttaacatttagatgcatgaaaattaggctgtatatgtcaaaagatgaaacagaggacacagaggcagcctctgtaaactggccagagccagtccatggtcagtggtctctcatcaggaagcaatgcttctcggttgttatgataaaactgcacaaagggaggggaatccaccacgtctttagaaaggactggtttatgtttaacccttaagaaagaaagtctaacggcagattagggagggagggaatgtaacaaggcatgcccgatctcccatcccatcatggtcagaaactcagtttttaagccatctctggggtctccttggccgagaaaggggtctcttcagtcgtttggggatgcttaagattttatttttatttttcagtatcactggatttctagtctcatattcaaacaaccattgattgaaagtattcaaaaaacaaccccaaaacaataaaagataataatacaacaataaacaataatacaaagaaacaatacggtaaaacaactatttacatagcatttatgttatattatgtactgtaagaaatctagagacgagttaaagtacatgagaggatgtgcatatgttatatgcaaatactacatcattttgagtaagagacttgagcatcacagattgtggtatctgcaggggtcctggaaccaatcctccatgcatgccaaggaacaatttcatgaaaagaccaaatattttgagttttatctagcctcaaattactataatgtagatagaggccacttttatttatctggagttagaccacagttttcttgttgatcctagtcgttttaggatttgatcttagatctcgcttatactttcagattatatttaagaatcaagcaagcagaccatataacatctaccctcacggaatcactgatgtccgtcctttgtattcaaggagattaccaaaaggtaaatattccctcgatttatagctcttttttacctgtagatacagatgagataaatatcatcaataacaactaaaattatgttggtcctttctccagctgttggccggacctcaagctccagtctaaagttataaaaatcaattataggaatcctcaggtgatgtttcatgtaaattcgtgaagagtcgcctgacatgtttttcctattacctagcggtgatgttcaaatattccacagccaattagattccactgcaattggttccactgcaactactgtaaatgccctaaaatcttgaagctggttcttctggcacttaagataatttttttttctgagtacggttttcagctacattccacacttttggtatctagtgtggtattccacactttgggtaactagtttgatattttcaggattctttgctgcagcttccatgttattgctcttccttgctctctctctctctctctctcaacagggtttcactctcacttttggtatctagtttgatattttcagggttcttcgcatattcatttctaaatagttcacaactccagtttttatttactatattgtttgctgtttaaagatttattttttcttttagtagattggatgttatgtatattctttctattatttaattttggatgaatatttatcaaaataatagatgtgtatgcttaaaactacaaaagggctgcctccctagaggcatccatttttaagaatttctgtttttgatttttggtggttatctctacatctctaaaaagttacttatactgctaactctttgtttttcaactttagacattatatacttactttgttttgtgcttttttccattcaagttgtttcagttttatcagtgttttcagttggattggctatcattagaactttaaaaatatactaaacatcaacttttagtaagatattttccaatcatggattgaaaatatcttttgactccatacttcataaattaaggatattaaaaactgtacccctcacttttcctttccccaaacctttcttttctctactgctgctagccattcctttacttttacaaaactaaacttgataacatttacattttgtgctgtaatttgaaataactcttccttgctttgtctatatattttctctaaagcttaaaaaattaaaaaacagcatttgtattattttagtattttagcaagtttcttttcataaatgttaactgcagaactgggtaatatgctatgattgctctcttttctacagctcaagtgattttactattaagataaaataatatgtggaaggaaaaaagttgatctcatagaagtagagataaaatagtggttactagaggctaaagaggggaaggggagggggaaatagggagacgttggttaatggatgcaaaattccagctagataggaggcataagtcctaatgttctatagcactgtagggtgactgtagtcaacaatgacatctattttcaaatagctagatgagaggatttggaatgttcccaacacaaaggtgtatcctgaagtaagactttgttttcttttattcggaaaagaaatgtaggcttcttcaaccctatttcttaggcctttcagcttcttaatcattctatgtattgcttgctatccaaatcttttattttttttttgagacagcgtctcgctctgtcacccaggctggagtacagtggcacgatcttggctcactgcaacctctgcctcccaggctcaggctatcctcccacttcagcctcctgagtagttgggaccacagacgcacactaccatgcccagctaattttttttattatttttattttttgtagaaatggggtgttaacttgttgcccagactggtgtcgaactcctgagctcaagcgatctgcctgcctcagcctcccaaagtgctggaaccaaatctttttcttcttaaagacattcttgtagtgaatagcattaactacttttcccttgtacatttctattttttgatttcttcttttgtttttctggaagtatattctcaagtaacttctaaatatgtggtacatagagggtgaactttctgaatccttcagtatcacatgatgggcagacagactggttataaaaattttcccgctgggtgcggtggctcacgcctgtaatcccagcactttgggaggccgaggcgggcagatcacttgaggtcaggagttcaagaccagcttggccaacatggtgaaaacccatctctactaaaaatacaaaaaaaatagccgggcattgtggcgtgtgcctgtaatcccagctactcaggaggctgaggcaggagaattgcttgaaactgggaggtgaaggttgcagtgagccaagatcaccccactgcactccagcctgggcaacagagcaagactgcatctcaaaaaaaattccttcccctgttttctaatattcattattgccgataagaattctttatttgcatttctttatggaagaatggcatagtgacagagttctggggagattttgaatgtgtgtcccgaaatttggaggcatacgtggatagttactggtaacctgcttttccatggagaattttgaaggctgtaatgcccataatagtgggcaagaagagagggcaagagtggagcagtttaccttcctgctgtttgacatgagtttattctgtaacaagtgaatactgttgaaagtagctgggctttatcccttttgaagatattctacccaagaaggcagttaggcaggctgaggggatagcagaaccaatagagtcttggatatatcactggaagtaagaagagctgatggggagaggagagttgcagaaggatagctgaaagaaacatctctcatgtcatggaactatgtaatgctgaggtccccatggtaactctaaagaaaccatacatgtgtcctatgaaaagaccagcatttgggcacctcccacacagagaacattgatgaccaaatagtgttgtcaaagatagagcagcaggacctgttaaacaagagtctgtttgccctttcttctattacctaccctccctcacccccagctcctggaaaagggaagagaaggctcagaaatattgaaagaacatactacaccattccctttctttctttctttcttttttttttttttttggagacagagtctcgctctatcccccaggctggagtgcattggcatgatatcggctcaacctctgcctcccaggttcaagcaattctcatgcctcagcctcccaagtagctgggattacaagtgcctgccaccacacctggctaatttttgtatttttagtagagatggcgtttcaccatgttgaccaggctggtctcgaactcctcacctcaacaccattccctttctatggatcctctaaccataggtcaggcataacttactgaggtgaggaagagcttagaatgaatataaaattaaaattttgatttagattgtatcttcaggtatgaaacatacccagaatgagacttaattactaaaatcagttcttgtcctgaggacccattaccctgagggcagatctcagttcttgctccctttcctcacagaagtcagagactacaccttaaaactccaatgccaagctctttggcatatattcaggcctgacactttcacagtcaaccggataatcaattacagctttttactttttaaaaaaattgtttgaatcttaaaattataataggtgcgactttagcttccacttgctcagaaacttcatatgtacatacagatttgtagaacccttgcaacaacaacatgattatcaatatgtggcttgttgtactctaattgagctatttatggttttgcttgtgggtaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccaggtgagttcttgcctttccaagtgctgggtttcattctcagtgtatgtccccttataacctgaagaaaatataatggtttgcaatataggtcagtaaaagaaatgagcttagcttttactaaatttgagtttcacgtagtaaacgtgcctgctggatggataggccatagaatgtaggccctagatttttcctatagtactcattcccagtctgggatttagctctctctagctgatcctccccatttttatatgtccaattaccacctattttcagatgacccacagatttatatctacagcctagatttcttccatggacatctcattatgggtgactcaaaagtacctcaaaattaacatgtctgcagcatgtagcactgttgcaggaagtcagggaccccgaacagagggactggctgaagccacggcagaagaacataaattgtgaagatttcgtggacatttattagttccccaaattaatacttttataatttcttacgcctgtctttactgcgatctctgaacataaattgtgaagatttcatggacatttatcacttccccaaccaatactcttataatttcctatgcctgtctttactttaatctcttaatcctgtcatcttcataagctgaggatgtatgttgcctcaagaccctgtgatgattgcgttatctgcacaaattgtttgtaaagcttgtgtgtttgaacaatatgaaatctgggcaccttgaaaagaacaggataacagcgatttccagggaacaagggagataaccataaagtctgactgcctgcagggccaggcagaacagagtcatatttctcttcttgcaaaagcgaataggagaaatatcactgaattctttttctcagcaaggaacagccctgggaaaagaatgcattcccagggggaggcctctaaaatggccgctctgggagtgtttatcttatgcagttgaagataagggataaaatatgccctggtctcctgcagtgcccccaggcttgctaggattaggaaattccagcctggtgaattctagtcagaccagttctctgctcttgaaccctgtttcctgttaagatgtttatcaatgacaatgcatgcacagcaggacatggaacctcattagtaattctaatttcgccctaccttgtgatcttgctctgtccctatttgccttgtgatattttattgcctttgaatcatgtgatctttgtgacccacaccctattcgtacactccctcccctttgaaaatcactaataaaaacttgctggttttgcggcttgggggcatcacagaacctgccgacatgtgatgtcacccctggagacccagctgtaaaatttctctcttttgtactctttctctttatttcccagaccggccgacacttaggtaaaatagaaaagaacctatgttgaaatattgggggctagttcccacaatatagcacagtgcatctcacttagtaagagcttaataggctacgtgcggtggctcacgcctgtaatctcagcactttgggaggccgagacaggaggattgcttgagctcaggatttcaagaccatcctgggcaaaatagtaagaccttgtctacaaaaaaaaaaaaaaaaaaaaaaaattagctgggcatggtggtgtgtgcctgtagtcccacctactcaggaggctgaggtgggaagatagcttgagcccaggaggtcgaggctgcagtgagcctggatgacaaagcgacaccctgtctcaaaaaaaaaaaaaaaaaaaaaaaaaaaagcttaataaatacttttgggcaaaacatagggaaagatataaaatatttcaaaatatggctagaatttggaccatttctactgctttaaaaaataaagctaaattctctgaacaagaaaagcttagttcttcacaaaaactcattgctcggccccagaataactcagtgccatattgctgaggcttgactacatgtccatttgattatatttatgatacataagatccctactagtctgaaaacatttcatatgtttagagagtaaagtatatgaactttggtgccaataaaacacatggcacataaactcagagaagtataaattttgccaagtacttgtcctgaccgatttttcctaactatagttttttcgtcacttttgggaagagaactgaaatattattctatattctccaatctcctctcttcagtattttggtttatatagctataggttataaaaaatgaggtttatacatattagtgaggtttacatatgaaatcttagcagatccaattagcaagcgactaattcataaatctggttcatatacaaaatgctcttctgaaaaaaatttgaatgttttaaacagaaaatttaaggtattagtgttgtttgacatttttgtggttcaccttatctttcttatttgatttctgtttttctatttttaattttttatagccttgtggaaggtcagttgctagatggaagtttaggaaagtcagtatctcatttgacttaactaacttaagaaaggcactgaataaccacttggttctttaaggagttaaatcttctaatctgaacatgaagagaataaggctacagactgtaccaaataaatcagctagcatatggccttgggtgcagaaaaaactaagttcagtgggatcagtcaccctcttgtcctggggacacatttgttgtaagcatatactcactgctcatagcacccaccctcaactcccaagccctggtacatgcctaagaggaaatggaattaaaccaatggattagatatatcacatgcatgccatcgctttcatcatagactgctagctcctacctgacaacatcagtagcatttctttacccctttcaatatatgtaattaacagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagtgagtaaagcagcacttaagtccagtgggtggtgaataaagaaaaattgatgtaatcaaagtgatgtccagataatgaatgaattgtatgtgcacataaatttaacaattatgttacctataaatgtataatttttactcaaacacacgtgatcatataacccatattttaaaaatccagtcaccattttttcctttcaatatttacttgatttccctctcccttttaattccctatctccttctatattacatcttttcaccaaccattccatgcccaggtaacatattttaagacatattttctctataattatataatcatatataaacacatacatacattgtattagtcttctagtgctgccataacaaagtactgcagactgggtggcttaaccagcagatatctattgtcttacaactctggaggcttgagatcaggatgtgggcaacgttggtttcttctgaggcttctctccttgtcttgtagatggctttctcccttgtcttcacatggtttctcctttatatatctttgtcctaatctcctcttctaataaagataccagtattgttgggctagggcccaccgtaatgaccttattttaactaactacctatttaaaaacactatctccaggtatagtcacatgctgaggtactggggtttaggactgcaaggtataaatttgggatgggggaacacaattcagcccattgcatacatacacatgtgtatatatttatatataccacaaatctgaatggtcaaaaatatggtaaaaaattccaattgcactatcctacagggaaatgcgaaatagaataacaataggatagcactttatacccatcaaactgccaaaattataattactagtgggcttgtggataaaagagtgttctcatgctatattagtggataagtagtatagtcttttcaaaaccaatatatgccttttgaaattctgattattaagatgtttaagatggagtgagccacatttccctgtgtgtcccactggatgcaactaaaaatcctgaacaggccgggcacagtggctcacgcctgtaatcccagcactttgggaggccgaggcaggcggatcacgaggtcaggagatcgagaccatcctggctaacatagtgaaaccccgtctctactaaaaatacaaaaaattagccgggcatggtggcggccgcctgtagtcccagctactcaggaggctgaggcaggagaatggcgtgaacccggaaggcggagactgcagtgagccaagatcgtgccactgcactccaggccggcgacagagtgagactccgtttcaaaaaaaaaaaaaaaaaatcctgaacgaaatgcatgggaaccttgaaaagttataatgtgagttatactcacctaccagaatgtggcatatgttacaattctatgcccctcctctcaaagctttagccctttaactttgggttgagcctcatatttagcttgaatttctagtaatagtgatatattattctccagagttaaagtcctttactatccattattctaaaaattttaaggttgtttagtcctttgagttgcatttttattttttacatagttcagggtattgctttccttctgaaggattcagatttcacatttgtgcaagagtctaatgcttagtatttaattctagtggcacagagctttttcttttctccctcttctctccagcctcatggctttggtttagaattccttcagcctgatagaatattgtattttataatttccttattgtgctatttactagatatttgttcttctatttttttctattcataatttctccctttcccaccacatctttttccaagtaggatgtgcacttgccacagtatctggacagttaaactgtctcattttcttggagacggtgatgaaaactagagagatatagtgacataagcagagccagaaaacaatttcactgaagatgatatatattttttttcctctgggatttctaatatagcttttggtggagataagagtctggaattgagaaagaagagattggaattgagaaaaagagtctgagaaagcacagggagagacacaaaggcagagaccaagagacacaggggaaggatcttcagaggaagagtccagggagaaagatgctaagacagagggataagaaaagaagaaaaaaaaggaccaggaggagagagacccaaaccataaatcactcctatttccattagcagtaaaattgataatctattttcatacaatgaaataccatgtgacaatgaagattcacaaaaataaagctatacacaacaatatgaataagtatcacaaagacaatttttagtaaaatggtaagtgtcaaaagaatatatacagtattatattatttacataaagttcaaaaatgggcaaaattaacttatatagtttagggatacagaggaagaaaagtataaaggttagtaaggacatgattataataaaagacaagatagtggctacctcttagaaagagttcatttgagaataaacacatgtgttttgtggggatagcagcaatattgtatttcatgacctagatgtttgttttataattttgtgttttaaaaaattgtaggatttatgatttatttcgtagatggatcctacaaatgatagggaaattgcagtaggaatgaagaggaaggaacatgtacaggatttgtttagaagatagaaggcacatgattttgtaaataattagctatgtttggtaaaggactaagaggattcaaagatgattaccaaatttctgatatgggtaactagaagaagagtgagacaaaatggaagaaagtgtatttaaagaaatgatagcaaaaactttccaaatctggagaaagatgtaaatatccacgtacaagaagctcaaagatctctagtcagattagattcaaacaagactatatgaagacacgttacaatcaaactgtcaaatatcaaagacaaagagagaatcctgaaagcaacaacaaaaaagaagcaaaccacatacaaggaaattccaataaggcagaaactttacaggtcagaagagggtgggatgatatattccgagtactgggaaaactttacctagaaaatgtttccttcagaaatgcagagagataaagactttgccacacaattccagttagacaagagaaataaattaaagacatctattgtacactatggtgactacagttaataaattacccattccaatatatacatatataaacattgtgatgtacatcataatatattctatttttccctgtcaattaaaaaataaatttaaaaagattggatagagaagaatcagccattctagtaattaagcctgaggaagcttacattccagtgatttcagataaccattatgcaagttaaggaataaactggataggatgatattaaaaaaacaaaaccaccaatgagatacaccagaatggctaaaattaaaaaggctgtccataccaagtattggtaaagatgtagagtaatgagaactctcataaatttctggtcaggaaatccaaacatcgaaagccaaacatcggcataccctattgactcaggaaatccactcctagtatacacctgttatgtcctgaatcatgtcccctagaattaatatgctgaagccctaacactagtatttcagaatgtgactgtatttggagatagggtctttaaggggtttattaagttaaaatgaggttgttacaatgggccctaatccaatatgactagtgtccttataagaagaggaaatgtgggccaggcacagtggctcacgcctgtaatcccagcattttgggaggccaaggcgggcggatcacgaggtcaagagatcgagaccatcctggccaacatggtgaaaccccatctctactgaaaatacaaaaattagctggacatggtggcgagctcctgtagtcccagctactcgggagactgaggcagaagattgcttgaacccaggaggtggaggttgcagtgagcagagatcacgccactgcactccagactggcagacagaccgagactccatttgaaaaaaaaaaagaagaggaaatgtgtacacacagagacaccagggatgcatattcacagaggaaagaccaagccaaggagaggtgtcagtaaaaaccaaacctgccaataccttgatcttggaattttagtgttcaaaactgtgagaaaacacattcctgttatttacacctcccagtctgtggtatattgttatggcaaccctagccactagtacagcacccaaaagtagtgtgtacatatttcacaaaagacatgtaactatttaatccatgtggagtgtcaaaaggcaaaaatacaacaaatgtattttaaagattgtaattggcttttatacatgattctagaatcagatagccctcagaaccaaatacagaacagcagccagcaacatagtatggatagaaattggaagtgaggtttagagacagcttaattgattacagttgggcatttttgccttatttgaagctgttagtcgcctgcaattgatggaagttcagctgctataatcggctgagactgagctgtttgttataaaagcatattcctaaattaggctttcagttagttcatcaactaagccaggctgcaactttgttgtgcaaggactcaagtgcaaaggtacccttaggcaaaattcagattaatttaaaaggactttacttttgttagttatgtgaaatgaagtggaatctattttttccaagtggatagtcatattttctattatcatttaccaactagctgatttttttcctgtactggttggagatgctgcctttattatatattaagtttcaacttattatatattaagtttccgcttacatcttgtcagtttctggactccatattttgtttgatatatttatctattctgcattaagactgcatttttaattataatagctttataatatctcaatgttgtataggaaaaaaacttcaattattaattagttatactaagccaatgtctaagtattgcttagtggtttgtgggcaaccatcttacacagtacctagtaacagagtagacaagtgtttattgaatggatggatgaatggatgtgtggaagaggctttcagaaacaattcccttcatagactaaggccaatgttacttttgcttagctctttagtttgaaataatttaaaatgtacagaaaagttacaagaataatacatggaacttgcacacaccctttacccagattcacaaatgtttaacattttgcaattttgtttttcattttcttttctttatatacacacttctgttacttattttctatttgaaaattagttgcagacatcacatccctttacctctcaatactttagtacacatttcctgtgaataaagatatcttttacataacagacacttcaaattgataaagcacatttccataatttacaactggtattccagttgtatcaaccaatgctgtcatttatagcattttcttctttgaagtacagggatctagtacaagtaactacttgtcctgcttctttcatttccttgaatctggaccttcatcagatggtaactttaagcacccaaaggtttttttctggtttctcctctgtgtagtttaagaccatgcaaacatcttgctactcatcaaaatgccccccatataacatccaaattaatctttatcatgatggtttatgactgtctcctcacattgggattggggcccaactgattattaacaatctacttttttggaagatataatatctcttcctgggaataagataatgggcataacatataataattcctaattgtatcatgacaatcacaatccaaaatactaaatctgtgatgtgtctaaatctcttttccccattgtttttgcaggcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggttagttattatatttttcttgtaccaacagctgtgaatgcttcactagccattcgtatgctcttttgcccactagctcacatgctgtcatttatagcattttcttccttgaggtacagggatctagtttctcctctgagtagttattattttcacccttgcaactaataaacagtttgaaggatcacgtagtagttctatttttagttttttgaggaacctccttactcttttccacagtatttgtacttatttacactcccaccaacagtgtacaagcattccccttttgccacatcctcaccagcattttttaattattttgtctttttgataaaagccatttaactggagtgaaatatctcattgtgcttttggtttgcatttctctggtaattagtgatgttgagcagtttttcatatacttgttggccatttgtatgtcttctttttttttttttttttttttttttcagacggagtctcgctctgtagcccaggctggagtgcggtggcacgatctcggctcactgcaagctccgccacccgggttcacgccattctcctgcctcagcctcccgagtagctgggactacaggtgcccgccaccacacccagctaattttttgtatttttagtagagacagggtttcaccgtgttagccaggatggtctcgatttcctgacctcgtgatccacccgcctcggcctcccaaagtgctgggattacaggcgtgagccaccgtgcccagcctgaatgtcttcttttgagaaatgtctattcagatctttgtccatttttaatagggttctttgttttttttgctattgactagagtttcttatatattctggttattaatgccctctcagttgtatagtttgcaaatatttcatcccatcctataaattgtctcttcactttgttaattgtttcctttgctgtccagaagctttatggcttgatataatcccatttgtctacttttgctttagtcccctgtgcttttgaggtcttacctgcaaaatctttcccagaccaatgtcctggcgcattcccccaatgttttcttccagtagtttcatactttcaggttgtatattttagtctctaatccattttgatttgatttttgtatatagtgagagataggggtatagtttcattcttctgcatgtggatatccagttttcccacaccatttattgaagagactattctttcaccagtgcgtgttcttggcactttgtcaaaggtgagttggctataaatgtgtggatttatttctgggttttctgtcgtgttccactggcatatatttctggttttatgccagtaccgtgctgtttttgttactacagctttgtagtatagtttcaagtcaagtagtgtcatgcctccagctttgttcattttgctccagattatttagctgtttggagtcttttgtggttccacacaaattttaagattcttttttctatttctgtgaaaaacttcactggcatttggataggtattacattaaatctggtagcattgatattttaacaatattagtttttccagcccattaaaatgggatagataccttttcagttttttgtgtgttcttcaattccctttatcagtattttagttttcattatagagatatctcagctctttggtttaatttattccaatatatttatttttattatagctattgtaaatgatttttaaaaaatttctttttaggttgttagctcttggtatatagaaatgctactgatttttgcatgttggttttgtatcctgcaactttactgaatttgtttatcagttctaatagttttttgatggagtctttagttttttgtgaaatataagattatgtcatctataaacaaggagaatttgacttcttcctttccaatttgggtaccctttatttctttctcttgcttacttgttctggcttggacttccaggactacattttatagaattggtgaaagtgggcatccttatcttgtttcagatcttaaaggaaaggcttttggttttccacatttggtatgatattagccgtagtttgtcatatatggcatttattgttttgaggtaagctttctatacccagtttgtttagagttttctcatgaagggatgttgaatttaatctttttggcatcaattgaaatgatcatttgtttttgtccttcattctgttgatatgatgtatcacattgattcatttccatatgttgaaccatccttgcatccctgggatgaatcccccttgatcatgatgaatgatcttttactgtgttgttgaatttggtttgctagtagttcgttgaggatttttgcatcaatgttcatcagagatattggcctgtagtttctttttgtgtatgtgtgtgtctttgtctggtttggtttcagggtaatactggccttgtggaatcagtttggaagtatttttcccccttgatttttgggatagtttgtgaagagctggtattagttctttttttttattattatacattaagttttagggtacatgtgcacaatgtgcaggttagttacatatgtatacatgtgccatgctggtgtgctgtacccattaactcgtcatttagcattaggtatatcgcctaatgctatccctctccccttcccccaccccacaacagtccccagagtgtgatgttccccttcctgtgtccatgtgttctcattgttcaattcccacctatgagtgagaatatgcagtgtttggttttttgttcttgcgatcgtttactgagaatgatgatttccaatttcatccatgtccctacaaaggacatgaactcatcatttttatggcggcatagtattccatggtgtatatgtgccacattttcttactccagtctatcattgttggacatttgggttggttccaagtctttgctattgtgaatactgccgctataaacatacgtgtgcatgtgtctctatagcagcatgatttatagtcctttgggtatatacccagtaatgggatggctgggtcaaatggtatttctagttctagatccctgaggaatcgccacactgacttccacaatggttgaactagtttacagtcccaccaacattgtaaaagtgttcctatttctccacatcctctccagcacctgttgtttcctgactttttaatgatcgccattctaactggtgtgagatggtatctcactgtggttttgatttgcatttctctgatggccagtgatggtgagcattttttcatgtgttttttggctgcataaatgtcttcttttgtgaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagttcccatttgtcaattttggcttttgttgccattgcttttggtgttttagacatgaagtccttgcacatgcctatgtcctgaatggtattgcctaggttttcttctagggtttttatggttttaggtctaacgtttaagtctttaatccatcttgaattaattttagtataaggtgtaaggaagggttccagtttcagctttctacatatggctagccagttttcccagcaccatttattaaatagggaatcctttccccactgcttatttttctcaggcttgtcaaagatcaggtagttgtagatgcgtggcgttatttctgagggctctgttctgttccattggtctatatctctgttttggtaccagtaccatgctgttttggttactgtagccttgtagcatagtttgaagtcagggagcgtgatgcctccagctttgttcattaggcttaggattgacttggcgatgcgggctcttttttggtttcatatgaactttaaagtagttttttccaattctgtgaagaaagtcattggtagcttgatggggatggcattgaatctataaattacattgggcagtatggccattttcatgatattgattcttcctacccatgagcatggaatagtcttccatttgtttgtatcctcttttatttccttgagcagtggtttgtagttctccttgaagaggtccttcacatccgttgtaagttgtattcctaggtattttattctctttgaagcaattgtgaatgggagttcgcttatgatttggctctctgtttgcctgttattggtgtataagaatgcttgtgatttttgtacattgattttgtatcctgaggctttgctgaagttgcttatcagcttaaggagattttgggctgagacaatggggttttctagatatacaatcctgacatctgcaaacagggacaatttgacttcctcttttcctaattgaatacactttatttccttctcctgcctaattgccctggccagaacttccaacactatgttgaataggaaaggtgagagaaggcatccctgtcttgtgccagttttcaaagggaatgcttccagtttttgcccattcagtatgatattggctgtgggtttgccatagatagctcttattattttgagatacgtcccatcaataccaaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttttgtctctgcccggctttggtatcaggatgatgctggcctcataaaatgagttcaggaggattccctctttttctattgattggaatagtttcagaaggaatggtaccaattcctccttctacctctggtagaatttggctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctcttttcttctttattagtcttgctagcggtctatcaattctgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccatctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttgttttacatttgctgaggagagctttacttccaactatgtggtcaattttggaataggtgtggtgtggtgctgaaaaaaatgtatattctgttgatttggggtggagagttctgtggatgtctattaggtccgcttggtgcagagctgagttcaattcctgagtatccttgttaactttctgtctcgttgatctgtctaatgttgacagtggggtgttaaagtctcccattattattgtgtgggagtctaagtctctttgtaggtcactcaggacttgctttatgaaactgggtgctcctgtattgggtgcatatatatttaggatagttagctcttcttgttgaattgatccctttaccattatgtaatggccttctttgtctcttttgatctttgttggtttaaagtctgttctatcagagactaggattgcaacccctgcctttttttgttttccacttgcttggtagatcttcctccatccttttattttgaggctatgtgtgtttctgcacgtgagatgggtttcctgaatacagcacactgatgggtcttgactctttatccaatttgccagtctgtgtcttttaattggagcatttagtccatttacatttaaagttaatattgttatgtgtgaatttgatcttgtcattttgatgttagctggttattttgctcgttagttgattcagtttcttcctagcattgatggtctttacaatttggcatgattttgcagtggctggtactggttgctcctttccatgtttagtgcttccttcagaagctctcttaggtcaggcctggtggtgacaaaatctctcagcatttgcttgtctgtaaaggattttatttctccttcacttatgaagcttagtttggctggatatgaaattctgggttgaaaattcttttctttaagaatgttgaatgttggcccccactctcttctggcttgtagagtttctgccgaaagatcagctgttagtctgatgggcttccctttgtgggtaacccgacctttctgtctggctgtccttaacattttttccttcatttcaactttggtgaatctgacaattatatgtcttggagttgctcttctcaaggagtatctttgtggcattctctgtatttcctgaatttgaatgttggcctgccttgctagatttggcaagttctcttggataataccctgcagagtgttttccaacttggttccattctccccatcactttcaggtacaccaatcagttgtagatttggtcttttcacatagtcccgtatttcttggaggcttcgtttgtttctttttattcttttttctctaaacttatcttcacacttcattttattcatttcatcttccattgctgataccctttcttccagttgatcgcattggttactgaggcttgtgcattcatcacatagttctcgtgccgtggttttcagctccatcaggtcctttaaccacttctctgcattggttattctagttgtccattcgtctaattttttttcaaagtttataacttctttgccattggttcgaacttcttcctttagctcggagtagtttgatcttctgaagccttcctctctcaactcatcaaagtcattctccatccagctttgttccattgctggtgaggagctgcattcctttggaggaggggaggtgctctgattcttagagtttttggtttttctgctctgttttttccccatctttgtggttttatctacctttggtctttgatgatggtgacgtacagatgggttttcggtgtggatgtcctttctgtttgttagttttccttctaacagtcaggaccctcagctgcaggtctgttggagtttgctggaggtccactccagaccctgtttgcctgggtatcagcagcagaggctgcagaacagcagatattggtgaactgcaaatgctgctgcctgatcattcctctggaagttttgtctcagaggagtagctggccatgtgaggtgtcagtctgcccctactggggggtgcctcccagttaggctactcaggattcagggacccacttgaggaggcagtctgcccgttctcagatctcaagctgcgtgctgggagaaccactactctcttcaaagctgtcagacagggacatttaagtctgcagaggttattgctgtcttttgtttgtctgtgccctgcccgcagaggtggagcctacagaggcaggcaggcctccttgagctgtggggggctccacccagttcgagcttcccggccgctttgtttacctactcaagcctgagcaatggcgggcacccatcccccagccttgctgccaccttgcagtttgatctcagactgctgtgctagcaatgagcaaggctccatgggcgtaggaccctctgagccaggtgcaggatataatctcctggtgtgccgtttgttaagcccgttggaagagcgcagtattagggtgggagtgacccgattttccaggtgccatctgtcacccctttctttgactaggaaagggaattccctgaccccttgtgcttcctgggtgaggcgatgcctcgccctgcttcggctcacgcacagtgcactgcacccactgtcctgcacccactgtccggcactccccagtaagatgaacccggtacctcagttggaaatgcagaaatcacccgtcttctgcatcacttatgctgggagctgtagactggagctgttcctattcggccatcttggctcccaatgcaaagaccttcaaacaacgtgacttcattttctcactcctaccttttgtgctcttgtcatttatttgaattctacatatattttaaaccccataagacattattattgttttatataatcaatatcatttatatatatatatatatttacacctttcatttctttcattcttttctgcatttcttgcttccatctatgatcattttctttttgtctgaagaaacttctttggaacttccttcagtgtgtgttggctagtaaaaagttctctgtcagtttttggtcagaatgggtctttattttgcctagatacaagtccttggttggatttacatattgtgaatgttttctcccagtctgtggtttgtcttttcactcctttaagggtgcattatggttaatagaagttcttacatttaattaattcttatttttcagttttttatggttaatgccttttgtattctgtttcagaaatttttgcctatcctaagaacatgatgccatccttctatattttctttctacatattttaaatattttcttctagaagtctgattgctgtgttgttcacaattaagtttatgattcatttttaattaattttgatggagtgatgcagataaaagttcatttttccatatggatatttaattgctctagcaccaattgttggaaaaaaataatttcctcactgaattgcactgttgtctttgccatgaatctgatgactgtatcactgtagctttgtttctgtactctatttcaggggtaggttatgatccacaagccaaatttgcagcttgtttttatatggcattgagctaagaatttttttacatttttaaagaattgtcacacaaaacaaaaaaaaagcaaaaaaacaaataaggatatgtatcatggaccatatgtgtctacaaacctaaaatatttactatgttgctttttacagaaaaagtttgccaacccctgatctcttatattccattgacttattggtctatctttgtaccagtaacatactatcttatagtaagttttaatatttgttagtataattcctccaactttgctctctttgatttttatataaattttagaatcatcttgtcaattttatcaataaaaatatcttctgaggttttgatagggattacattgattctgcagatcaatttgggggagcatacctcttgacaatattgagtattcctgtccatgagcatggtttagttatttatttacatcttttaaattttctcttggcaatgtttttgtaaaattttagtgtacaggtcttgcacatttttgtaaagtgtattctttggtatttaatgctattataatattttttatggtatcagtttttgtcaattgtgtttttctagaaatatgtccctttcatctaagttgtttaatttacttgaagtaagttatttgtaatgttcttttatcatccttataatgtctgtactgatgtctccgttttcatacctgatattgttatttatattttatctattttaagtttatcgcctgcacccactaactcgtcatctagcattaggtatatctcccaatgatatccctcgcccctccccctagtgcacatgtaccctaaaacttaaagtataataaaaaaaaaaagtttgtcgcctttgttataggttcatcaaatttactaatcctaccataggatcaaatttttgctttgttcatcaggtcatggaattaaaaaaatttttttgttttgtttattttctatgttgaatttttatttttattttgctttgcatttcatttatttctggtcttttgttattattccaatactttctctggattcagttttctttttcttcttgacttcttgagattaaaacttggttcattgattttcaacatttcttactttttaaaagttcatacaaagcataaatttccctttatatactgctttaaccccatatcacaaattttgatgagtcatatttttattatcattgagtttaaaatattttataaattttacgttatttcttgttttattcatagttattttacagtgttttacttaatttcccaatatatggcgattttctggctctctctctgttgctgatttatttgttttactgtgatcacataacatactctatattatttcaatcatttgaaatttgttgagacttgctatatgcccagtgaataatttaatttgattaatggcccactgcatttgaaacaaatatgtctttgctgttattgggtagagtgtcatatatttgcctattatgtcaagttgctttatcatgtttttaaaatccttataaacttcctgatattttatctgtttcttacagacatggaggaaactgtgacatctctgtgattgttgagtttgttattttgatttttgtatttgttagtaagaatgtttcaaaataaatgaggcaatataaaatcaggtgcttacaactttaaggttgtattcttattaaatcaattctttcatctttgtgaaatgtcctttttgtctgaagtagtacttgttgccttaaacgtctgcattgtctaaaatttatacacctgcactatcatatttattttgcttaatgtttgtgtggtatatatttcccattcttttcttttcaacctatctctatccttatatttacagtgtgtcttttttaacattttctgtagtgcaagtctgttggttaattaattttgtcagtttttgcttctctgaaaagtctttatttctgtttttgaattatatcttcactgtgtatagaattctgggtttgtggttgttgtttttgttttattacattttgttttattggtttttccctcagcactttaaaaatgccgctccattgtttctacttgcatagtttttcacaataagtttgttgtaattcccatttgcattcaactgtacataatgtatctttttaaaaaaatctggatggcttcaagctctttactttgatttttgtgtgtgtgtgtgtgtgtgtgtgtgtgtgtgtgtgtgtgtgttactttggcattctctaggcttattcaatctgtaatttggtatcattaattttgaaaaatatttatcatctgtgtcttcaaatattgcttctaattctttctcttcttctggtattgcatttacatatattatactgttcaattttgtcacacagctcttgaatatgctgttctagtttgttttctaactatttttccttctagttgttcagttttgttgacatttattgacctatttttacttcagtaattgtttcctgggttgttgagttaattgatgaactcatagatgacatacaatttatctttttattcttgtgtcacttgtgcttttgatgtcacatctaggaaggctttgtctagcccaaggccacatttacttccatattttcttctaagagtttgatagttgtagctgttacatatatgtctatgatctagtttgaataaatttttgtgtatggtgtgaagaagaggtctaacctcttttttattttttgcatgtaaacatccagttgtcccggcaccatttgttgaaaatatgattcttttcccattaagtcatcttgacacccttgttgaaaatcaattgaccataaatgtgagagtttatttctgaactctccattctgttccattgacccatacgtcttctataaattcttatagctaattctacattagactttggtttttcagatgtggtcatctcattagattatggtgatatgtttggttacaagttttatcttctccttggcaacattttttttattactgctcttcttttattcgtttttgttgttcctttctctttttgtgagacagggtctcactctgttgcccagggtggagtaagtggtgtgatcatggctcactgcagcctcaacctcctgggctcaagcaatcctcccacctcagcctcccaagtagtgggactacaggcatgcaccatcatgccaggctaacttttttattttttgtagagacagggtcttgctttgttgcccaggctggtcttgaactccaagctcaagcaatcctccaacctcagcttcccaaagtgctgggattaccagtatgagccactgcacctggccttgttgttcctttcttccttttatcttgtagtatcttgatcctttttgcttattatttatcattgaggtgagtttgttctaaataaacttttcgcagaaagtttatgtagatatattaatatcaatgaggcattaggagtgagttttagattagcaggaattctcttatgaaaggtattgattgtatgtgtgagttttcagcctttacttctctccagcccatcaagatcaaagctgcagagttgtttacatttcagaatttctttcctcccctccccaccttgcaaaacagacttacagtgcaaaaatgacttgtcaatgtgattctttcttctggtcccatctttcctaccttttgagacttgtgttgaaaggagtccagtaaaaccaccgatgctagcttgtataccctgatcccattgttataatgaatgactgactgtttttcatatcaaagtataatacttgcaccttgatagaagaaagaaacaaggccaggcacagtggttcatgcctgtaatcccagcactttgggaggctgaagtaggaggaataattagactttgatattaaaaatggggaagatatggcggtataagatatgaggaagtatgtcttcttggacttttctgaaatctgccagccatgagcatccactctttttatcttttgatacctgttttatattaactatacttctattttgtggtttcatggcttcagatatcttccagcttaattgtactctgtctttaattatttgcagcaatttctgaaaggagcaagaagaaaggccagccctttcttcactaccttaaaaactggtcatcttttgaaaccccatgaaaggcacagtgggtgaccatctacatcaggagtgggcaaactatggcccttgggtagtctggtctctgtccgtttttgtaaggttttattggaacccatacacacacaaactgatcatctcttgttatgtgttaagttttcttataattattcttttctatttcatccagctgaattaccatttcaccttgtgtatgccctttccagtcttaaattatagaagctatgtctttgtggttttaaattatggaagctgtgccttcttgtgttttagtatggcaagatatttgttcttacttttcctctagaatctgcagtggattactttcagaagtaggtattgcctctaagtttcctgacttctgtttccttctccctgttctgtagtatatttatagattgcatgttttctcgtccttaaacaaggtacaaatatgttctgatcaaggtttgctagccgagaggataagtggcttgctcttagcctaactctctgtctacttaatggatgtcgaattcccttctcaactcaacagctagtaactagttccaagatcggataatagcttacagaattaattagttcagtgaaagccctggtttgatcacagaggcaggagactgatctatatatttgtagtgctgactagaccccaacttggccagatagcttatacctatgtcagaagttggaggaggagattgacagctgaggtgtctccaagggaattacaattattttcattttctttgtgtctgtaattatgtctcttttcttacttcaaattttgtatatgtgaaatttcttaatttttatttggttatttattttattgactttttcatcaaacaaccaactctaagttcttggattgaaatttatgaattaattataatgttttaaatttaccattagtcacacatacaatacaaaaagatattttcattacaaaattttaacccaagccattaaaactaaactccagcttggtcaccattcctaataccaggcccctctcagaggggagggtaaataaaagtccattttggtaactagtttgacgagaatctctaattgtttccctgtttttcttataatgtctgcctttgaattatcctctttttttcaagagttccatcatataatgtattcctttttgcttacagattgacctcctagaggcatgcatccccctgctccagtctgagctggttctctctaggcctgaggctcagttatcaacttgggacttttatttaccctccctcaggataggtacctggttcttggataccaggtcttactcttgtttgagatactcctttattttggtggcaaacattccataatcacttcctgataatggtgacatttgaggtagattttctgagtctttatatgttagaatatgtttttattctcctttgccacttgattgataatttggctgcacatagaatgtaagcattcacagggcttttgggagcagcttcccttgagaagaaggtggatgcagttaagatcttccctgaaaagactgtgtgaaatgacaaggctattgaggtacccaacgggtagcttggtaaaggtgtatcttgtctcttatgtttatgcatctactttaccaccatgtaattagcctattataacttgttgcattccttcactcagctaatcttgttcatggtagaaattaatattgctagtaccatggtagaattttatattagctggatcctagacctaaatgctccttccttgtgcttacatattctgcaagtgggtgacagtggatgctaggtattgtgttatgtgatttcaatgtattatatgatggggtagatactattagcctcatttgaaaattagaaacctattgttcagaaagtttaagtgactttctcaaagtcacacagctggtaaatggtagaactgggatttgaatccaggcaatctgatggatttaagaggaacctgtgccactatgtgatatagcaataacatctagccaatataaatactttcctgaattaaatcactgtcatattcagagagttctgtgtcactattaagaccctccattattgtgtatattaattacatttccctattttaatcccaatatctattcatttttatcacagtcctttcttatggtcacaaacaggcatagtacaacagcagcaatgcaaaaaccacttttatattacatgttccagggatttaacccaatgacctgtgatataatgatactgactagtattttttcatttatctgggaatgggagagaacctctaacagaacgttttagaatctgtgttatgagtaaccagagtcttattcttcctcatctccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgagggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacaggtatgaatgcattggttattcctttgctctgctcttgtgacatttgactttaccagatgatgacaccaacaatgagagttagaggatgaaaaatcaaggtgtcttgaaactcttactctggtgagatagagagaagagaggtttacaagagggtagaggaatcagggacaagaaggagcaatggggagcaggaagaaagtcaacctcacctatcaaccttatgagctgcaggggaaatcttagtctcatcagagaactttaagcaaggcagaaggaagaagcaagttcgtgttaaagaggttaaggacttggggaggattggttttcatgatactggggatccagagggcaaagtaggatgattttatttttaggtgagtagagggaggttgagcagtcaagtagtacagagaaatgtggaatataaacataaggagagtcagtcagtcacaaatatttatggaacacctactacatgccagacacttttgtacacattggagtgcagcacagcaggagcttatattctattggaaagagcaagagacaagttagtacaaaactaaataaggcaatctcaattgtgttgttcagaagatagaatagaataatatggtagagagaataatatgatagagtaatacggtagagtgttacattagctgtggtggtcatagaaatcatctttgaggagttgagacctaaatgatgataacaggccagctgatggagctctgagagaagatgtttccagacagagggaagagaaaatgcaaaggccctgagaatggaaaaagtttaccatgtttgaggaacaagaagggacaagcatgacttgtcactttcccaccttgctttctagctcaagtaagcccttattgctgcattgcaaccatagactatttccctagtccactgactttctcattctcctggacctctatcttagattttctgtgttttccttaaatctcgagcaccttttttccattctccaatgcccattttcactcttagctgatgctgtgcaatgaacctccacagactcccaacatcacatttactggcatttgtacccatatactctgcctgcacacttattacaataaatagagtgtctgtgctcctaaggccaacctctccagttttgtacttgattcccatctcttctcccttcataaaaaatgttgctccagcaatttctccttttctcccttacatcatcaatttatctctccactagattaatctcatcaacatcaatcatgctattatttcctcccctatctttacagaaaccgtcttaaaataattgtccctgcttgcagcctttgcatcttttcctgccattctctcctctttaacccactccaaagaagcttttatctctattatttcataagaactacattttcaaggtcattattgatctttacattactgattactagccctcatcttatttgaattctcagtagtatttgagaggtgattactccatcgttgatacaggttctcacttggtttctctaacaccacttttcttcacttttctactaaacttactgccaatctttgtcaactttgcgagtccttcttcatccccctaatctttaaaggttagagtgctccagggattagttctccaacttcttctttattctatttatactcactctgtgacgacattgtttagcctcatgattttaagtactatctatctgcagataattccagttgaatatctggagatattctcagatctctctcctgaagtcaaaatttacatatcaactccctaccttaacatgcacacaattagactcttaattcctgccccttcccaaaacctgctgattgctcagccttctccatggcaatcaaaaaccattcctggccgggcatggtggctcactcctgtaaccccagcacttggggaagctgaggcaggtggattggttgagccccagagttcaagatcagcctgggcaacatggcaaaacctcatctctattaaaaatacaaaaattagccaggcgtggtggtgcacacctgcagtcccagctactcaggaggctgaggcacgagaatcgcttgaactggggagacggaggttgcagtgagctgagatggcctcactgcactccagcctgggcaacagagtcagacttgatctcaaaaaaataaataagtaaaaccattccctatttcagttattcagtcacagatcttgaagttttccaactctttttttcttacattaacatctaatctgtaaaggatcctgtattagtccattttcacactgctaataaagacatacctgagactgggcaatttacaaaagaaagaagtttaatggactcacagttccacatggctggggaggcctcacaatcatggcagaaggcagggaggagcaagttatatctcacatggatggcacaggcaaagagagagagcttgtgcagggaaactcctctttttaaaaccatcagatcttgtgagacttattcactatcatgagaacagcaagggaaggacctactgccatgattcagttacctcctatcaggtccctcccacagaacatgggaattcaagatgagatttgggtagggacacagccaaaccatatcattccaccccatcccctcccaaatctcgtgtcctcacatttcaaaaccaatcatgccttcccaacagtcccccaaagtcataacacatttcagcattaactcaaaagtccacagtccaatgtctcatctaagacaaggcaagtcccttccacctatgagcatgtaaagtcaaaagcaagttagttacttcctagatacaatggggtataggcattgggtaaatacagccattccaaatgggagaaattggccaaaacaaagggcctacaggccccatgcaagtctgaaattctacggggcagtcaaatcttaaatctctaaagtgatctcctttgactccatgtcttgcatctgagtcatgctgatgcaagaggtgggtgcccatggtcttgggcagctccacccctgtggctttgcagggtacagcctcccttgtgtctgccttcatgggctggcattttctgtagcttttccagatgctggtgcaagtttctgatggatctaccattccggggtctggaggacggtggccctcttctcacagctccactaggtggtaccccagtagggactctgtgtgggtgccctgagcccacatttcccttctgcactgccctagcagagtttctacatgaaggcccacccccgcagcaaacttctgcctgggcatccaggcacttccattaatttctaaacaacaaagcattcaagaggcgacttgggtgctattaagggcattcagtttcataagggaagcagagcataaaagtttggaaaatttgcagcctgataatgttagagaaaagcaaatcccattttctgaggagaaattcaagcaggctgcagaaatttgcataagtaatgaggagccgaatgttaatccccaagacaatggggaaaatgtctccagggcatgtcagaggtcttcacaccagcccctcccatcaccggcccagaggcctaagaggaaaaagttgtttcatgggctgggcccaggatccccatgctgtgtgcagcctagggagtcggtgccttgtgtcccagccgctacagccatggctgaaaggggtcaatgtagagctcaggctgtggcttcatagggtacaagtcccaagccttggcagcttccacatgatgttgagcctgcgagtgcacagaagtcaagaactggggtttgggaacttccgcctagatttcagaagatgtatgaaaacacctggatgcctaggcagaagtttgctgcgggggtgggccctcatggagaacctctgctagggcagtgcagaagggaaatgtgggctcagagcacacacacagagtccctgctggggtaccacctagtggagctgtgagaagaggaccaccgtcctccaggccccagaatggtagataccctaaatcatctctttcaaattcgaagttccacaaatctctaggacaggagcaaaatgccaccagtatctttgctaaaacataacaagagttacctttgctccagttcccaacaagttcctcatctctatctgagaccacctcagcctggatttcattgtccatatcattatcagccttttggtcaaagccattcaacaagtctctagagagttccaaactttccacattttcctgtcgtcttctgagccctccaaactgttccaacctctgcctgttacccagttccaaagtcgcttccacatttttgggtatcttttcagcagcaccccactctactggtaccaacttactgtattagtctgttctcacactgctgataaagatatacctgagactgggaaatttacaaaggaaagaggttttatggacttactgttccacatggctggggaggcctcaaaatcatggcagaaggcaaggaggagcaagtcttgtcttacatggatggcagcaggcaaagaaagaaagcttgtgcaggaaaactcttttttttcttttcttctttttagacagagtcttgctctgtcacgcaggctggagtcagtggcgtgatcttggctcactgcaacctccacctcccgggttcaagtgattctcctgcctcagccttccaagtagctggtactacaggcatgtgccaccacatgagatgagattttggtagggacacagccaaaccatatcattccccctgtcccctcccaaatctcatgtcctcacatttcaaaaccaatcatgccttcccaacagtcccccaaagtcataactcatttcagcattaactcaaaagtccacagtatttttagtagagatggggtttcaccatattggccagactggtctctaactcctgaccttatgatccgcccgccttggcctcccaaagcactgggattacaggtgtgagccaccatgcccagccaaaaactcttctttttaaaaccatcagttctcatgagacttattcactatcacaagaacagcataggaaagatctgcccccatgattcaattacctcccaccaggtccctcccacaacacatgggaattcacgatgagatttgggtggggatcctcttggctatcatttcaaaaaatagtcagggttgattatggacttagtattgaataagatgaaaatgtactgaaatggaacgatgaagataattgaccagggaaagcaggttacaagccaagagaggatacagtgtcacttcagatgctataaaagtgatgtttttattttttgaatgttatttggctatattttcaaattatctgcactgcatatgcactgcttctgtaataataaaagggtattaaaataataaaatcaagtctataaatcacacacacacaccccagcctcttctctacacctcagtgactaccaaccacatctaaattatcatcatttctcatctgaattattgcaagaagccattgcaataattcagatgagagttgatacaaagccttcctgtttccaaccttaccctcatatagtcttttcccaacattgcatctaaagtaatttttcaaattgcaattctgatcactgttctctgcttcagatcctccagtggattttcatctcactcagtaaattccaaagccttcaccatggccttcaagaccctacgaaatttgaccctctgcaacctctctgccttcatctgttaccattgtctcctgttaatcctgcctcagccacactgacctccttgttcttctcaaatggactagatgtgtgcctatctctagaccattacagtttctgttctctctacttaaaattatgtccctgatactctaatgcaagttctcttacttccttcaggacgctgctcaaatttcattttatcagtgaggctttccctgaacactgtatgtaaatattgctcccaccattttttttcaatgcacttaacagtgcctgaaatattatatatttatttctttattgtctatcttctctgactataagttaagctcattaagaacacaaactttggaggtattgttcaatgttgtgtccccagaactttgaacagtgcctggcacgtggcagatgttcaaataaatgtatgttgaatgaattagaaaatgataaatgtagggagacaaaagcaggtctcccatttatatccaaactctaggactctaggaaagactgattatatggaatcgtgtcacacagcatccatgggcaagagtggaggcagagataccagttaagatgctattgcagtcatacagataaaagaagacagttatttagaccagtgtggtggtgacagaaatggaaagaaatggaaggatgttgggtataattaaagataagcatataagactggctgttaattgagtatgggaagaatgaggagagaggatgtaaagaacatttctttttgtttgtttgttttgttttgtttttgtttctttttattatactttaagttctagggtacgtgtgcacaacctgcaggtttgttacatatgtatacatgtgccatgttggtgtgctgcgcccattaactcatcatttacattaggtatatctcctaatgctatccctccctcttccccccaccccccaacaggccccggtgtgtgatgttcccctacctgtgtccaagtgttctcattgttcaattcccacctatgagtgagaacatacagtgtttggttttttgtccttgcgatagtttgctgagaatgatggtttccagcttcatccatgtccctacaaaggacatgaactcatccttttttagggctgcatagtattccatggtgtatatgtgccacattttcttaatccagtctatcattgatggacatttgggttggttccaagtctttgctattgtgaatagtgccgcaataaatatacgtgtgcatgtgtctttatagcagcatgatttatagtcctttgggtatatacccagtaatgggatggctgggtcaaatggcatttctagttctagatccctgaggaattgccacactgacttccacaatggttgaactagtttacagtcccaccaacagtgtaaaagtgttcctatttctccacatcctctccagcacgtgttgtttcctgactttttaatgatcgccattctaactggtgtgagatggtatctcactgtggttttgatttgcatttctctgatggccagtgatgatgagcatattttcatgtgtcttttggctgcataaatgtcttcttttgagaagtgtctgttcatatcctttgtataagattattagtggatttctcagaagaaatattgtagaccagaagggagtgaaaatatagatttaaaatcctgaaaggaaataaaaactagcaatgaaaaatactatatccagtaattttatctttcagaaatgaaggggtgataaagattttctcagaaagacaaaagctagatctgctttataagaaatgctagtaggagttcttcaagctgaagaaagaggatgcttattagtaatatgaaaacatatgaaaggataaaactcactagtaaaaataagtacattgtcaaatccaaaacactctagtagtgtaatggcagtgggtaaattaattatatctttagtataaaagataaaagacaaagaaagctattttaaaaactaaagctataataatgtgttaaggaatgcaaattattaaaatatgtaaactgtcacatcaaaaacataaaataggctgggcacagtggctcatggctgtaatcccaacactttgtgggggccaaggtgggaggatcacttgagcccaggcatttgagactaacttgggcaggatagtgagatctcatctctataaaaaatttaaaaattagtaaagcatggtggtgcatgcctgtagtcccagctactcaggaggtggaggtgggaggactgcttgagcctgggggggtcaaggctacagtaagcaatgatcacaccactacactccagcctgggcaacagagcaagaccctgtctcaaaaaaaataataatatgtaggaggaagggaataaaagtgtagagtttgtggatgcaataaaaattaagttgttatcagtttaaaatagcctgctaattttgtgtaagcctcatagtaaccacagagcaaaagcctatagtagatacacaaaacattttaaaaaggtccaaagcataccactacagaaagccatcaaactataaaggaagaatgcaacagaagaagaaaggatcaaaggatctaaaaaaaaaaaaagaaagaaagcaattaacaaaatgacacaagtatgaccaaagtccactgcttctttattactgatatagaatatctttcagatcttaagggactgattaattacttgggagagaaagtttgtgttgagaagatttgcttgtgttgcaatgagaaggggaagttctactcaacagaagctgtacaggcacatatgacaaaagctggtgtaagctttttacagatggtgatgctgctttggaatttgcagacttgtatgagtttaggagtagctacccagatcacaaggaaggggaggaccctaatgaggctgaggagtcgcccttaggaaaggacttagaatatgatgatgaaagcatggaactgattctgccttctgatgccagagtgggtcatcactccttgatgagatactacaaacagtgatttggcttgtcaagagctgtggtagttgctaaatattgtgaggccatgggccgagtgcttcagtaatagagagccctgggatagactggcaacacaggagcagctgttacatgaaagtgagacatgcattatatccaaaggatgaagtcaaaatggatgctgaagacagaaatgaagaacaatgccaccaagcagatgcactttagggtccaagtgagattctgagagtctgccaggattgagtgattgtctgctgcccaagtttcctccttgccctgaggaccagggaaagccagattgtatgatggacacttttgctgctacttcacttgctctaacataataataaaaatgaaaatctaaaaaatattttattgaagaatgaaggtgaaagaaatacattttcagacaagcataaacagagaaacttcaccattagcaaaagtccactaaaatattctaatgttatacttgagacaataaaaaagtgatacagaatggaaggcatgagagacaagatgggataaagagcaaacaaagttaaatatgtggataaatagagataagtatcataaaacatggtcaaatgttttatgagcgttaagatatatagaattgctttattcacagttggtttgctgtcataacacaagtatcatgaaaatcactgctaaatctaagccaaaattgggaaaggaaaaggttcatgtcactatcatcaacgttggacatgtagactcaggaaagttcaacactactggtcatctgatctataaatgtgatgtgatcaacaaaggaaccattgaaaaatttgagaaagaacctgctgagatgggaaagggctcatttgagtatgcttgggtcttggataactataaactgaacatgaatggaatatcaccattgatatctcctaaagaaacctgaggccaaaaatatcctgtgaccatcattgatgccccagcacacaggggctttattaaaaaaaaaaaaaaaaaaaaaaacatgattagagtgatatcaccaaaatggtggatagaagcaatctggcttcactctcctccagaaaaaccaaaaacaactattcagtgtctagcttatcaccaggaatatcccataactcaaaacagaggctgtgaggatctgagtggccacatagaagagaaaaactgcaagcagaagataacaaaaatgggcctgtttaactgcagcatccccttcccaagctgccaggcaccatgcagaaaagttcccccagactgacagtatgtacatcagaaaaagtgacatctagatgaagagccagctttcccaccatcttgggttcctttgcagaaaaatcattcctgcctcaatccgtgggaagcagcctgattgcctctagggtaaaaaaatcctgagggcagctagagacaaaggatggaggcggggctagcaaccccagcatgcaaaacacattggctgctcttcatctaagccaaagaagacaccaaatgagagagaatgttcagcccgtggttcctctggacacaaaatcctaaccagatgtctcacccaaccaggatatccagtttgggacctcccccaaatcgggaataggcagtaatccaagccgttgcaagagctgcagcaaatctgggcttacagcaccatctagtgccaaaaaagaggcagtaatctcagagtaaggaagctctaattcatacataacctttagacaggcatactcctgaaaaaccaaactaagccagacacaaagactggaataaataacttagcattcatacaaagacatagatatatgtgcataaaaaacaagagcaaatagggagctatgacctctccaaatggaaacagcatggagccagtgaccaaccctaatgagatggcaaattgtagctctcaaatcaataattcaaaataaaagttctgaggaaactcaaagaacacaaaaaagcaactgagaaatttatgagataaatttaacagagaaatcaaaataataatttaaaaaaccagaaatgctggagctgagaaatacaactgaacggaaaaaaaaaatgcactggaaagtctaaacagcggaactgatcaagcaaaacgaacaatcaatgagctcaaagacaggctatttgaaaatacacagtcaaaggacaaaaaataattaaaaggaatgaagaacacttgcaagatctagaggactgcctcagtagaacaaatctaagagtcatgggccttcaagagagaaagagcaatgaataaaaagctcaaagaaataacagaaaatatttccaaacctacagagagatgtaagtatccagttataggaaggctgaagatcaccaaacagattcaacccaaataagactaccccaaggcatacaataattaaactctcaaaggtcaaagacaaagaggggatcctaaaaagagcaagaaaaaagaagcaaataacatataaaggagctccagttcatccgggaatatactctggaccagatgaacctacctgacattttacagaacattttatccaactactacagaatatacattcttcttatcagcacatggaacattctccaggatagactatatattaggccagaaaacaagtctcaacatttaaaaaaataaaattatattaagtatcttttctgactacagtagaataaaactagaaatcaatgacaagaggaacgtttgaaactatacaaatacatggaaattaaacaacatgctcctgaacaaccaataagtcaatgaagaaattaagaaggaaatttattgaaacaaatgaaaatggaaacaacataccaaaatgaatgggatacaacaaaagcggtactaagagagaagtttatagctataaatgcctacatcaaaaaagaaagactcaaataaacctggtaatgatgtaactcaaggacatagaaaaacaagagcaaaccaaacccaaaattagtagaaggaaaataataataataatcatagaaataaataatattgagaaaaagaaaacaatatgaaagaccaatgaaatttttaaaatggctttttgaaagataaaatttaaaatctttagctagactaaggaaaaaaaatgagagaagacccaaataattgaaatcaaagatgaaaagagtcattaaaactgataacacaaaaatacaaagtttcactagaaactattatgatcaactatatgccaacaaactggaaaaactagaagaaatggataaatttctggacacatacaacttaccaagattgaactatgaggaaatagaaaacttgagcagaccaataactagtaatgagattgaagcagtagtaaaaagtctggcattaaataaaagtccaggacctgatgacttcactgctgaagaaaaacttacaccaattatactgaaactatttaatattgcaaaaaattgaagagaaaagaatgtttccaaactcattctacaagaccagcattatcccaatacccaaaccagacaaagacacaacaacagcaaaaagaaaactacaggccaacttcgctgatgaatatagatgcaaaaatcctcaacaaagtactagcaaactaaattcaacaacacattaaaatgagtatttgtcatgcccaagggggattcatcctaggaacacaaagatagttcaacatatggaaatcaataaatgtgatacaccacattaacagaaggaaagacaaaaaccatatatttatttcaataaatgtcaagaaagcattgaataaaattcaacatcccttcatgataaaaactctcaacaaatttggtttaaaggagcatacctcaaaacagtaaatgttatatatgacaagcccacagctaacattacaccaaatgggaaaaaattgaaagcctttcctctaagatctggaacaagacaagcatgcccactttcatcaattctattaaatgcagtcctggaagtccaagatggagcaattaagcaaagggccttcaaattagaaaaaaagaaatcaaattccccttgtttgtagacgatataatgttatatttagaaaaacctaaacactccaccaaaaaactgttagaactgatcaacaaattcagtagagttgcaagaagcaaaaccaacatacaaaaatcagtagcatttctatataccaagagctaacaatccgagagagaaatcataaaagcattttcattttcaatagctataataaaaataaatatctaggaacaaatttaaccaaagaggtgaaagatctctatactgacaactgtaaaaccctgatgaaaggaattgaagaagacacacaaaaaatgaaaaggtatctatcccatgttcatagaatggaagaattcatattgttaaaatatcaatactactagatttcatgtattacctatcaaaataccaataacatttttcacagaaatagaaaaagcagtcttaaaatttgtacagaaccacaaaagacccagatatggtttggctgtgtccccacccaaatctcatcttgaattgtagttcccataatccccacatgtcgtgggagggacccagtgggaagtgattgggtcatgggggcagttttcccccatgctgttctcgtgatagtgagtgagttctcatgaaatctgatggttttctaagtgtttggcatttcccctgctggcacttattcccactgccaccttgtgaagaagatgccttgcttcccctacgccttccaccatgattgcaagtttcctgagacctccccagcaatgcggaactgtgagtcaattatacctctttcctttatagattacccagtctccagcagttctttatagcagtatgagaacagactaatacagtaaattggtaccgaggtagggggggcactgctataaggatacctgaaaatgtggaagcaactttggaactgtgtaacaggcagaggatggaacagtttggagggctcagaagaagacaggaaaatgtggcaatgtttggaacttcctagagacctggagggctcagaagaagacaggaaaatctgggaaagtttggaacttcctagagaatcattgaatagctttcaccaaaatgctgatagtgatatggacaatgaagttcagactgaggtggtatcagatggagatgacgaacttgttaggaataggaataaaggtggctcttgctatgctttagcaaagagattggcagcattttgcccctgccctagagatctgtggaactttgaacttgagagagatgatttggggtatctggcagaagaaatttctaagcaacaaagcattccagagtgacagagcataaaagtttgaaaagtttgcagcctgatgatgcagtagaaaagacaaacccattttctggggagaaattcaacccagctacagaaatttatataattaacaaggagccaaatgttaatcaccaagataatggggaaaatgtgtccagggcatgttagagaccttcgcagcagcccctcccatcacaggcctggaggcctaggagggaaaaatgctttcgtggcctgggtccagggctcccctgcagtgttcagcctgggacttggtgccctgtgtcccagccactccagctataagaggccaaagtacagcttgggctatagcttcagagggtgcaagcccccagcctttgttctgtgggtgcacagaagacaaaaattgaggtttgggaatgtccacctagatttcagaggatgtatggaaatgcctggatgtccaggcggaggtgtgctgcagaggcagagccctcgtggagaacctctgctagggcagtgaggaaaagaaatgtggggtgggagcccccacacagtcaccactggggcactgcctagtggagctgtgagaagagggccactgtcctccagaccccagaatggtagatccactgagagcttgcaccgtgggcctggaaaagccacaggcactcaatgccagcccatgaaagcagccaggagcagggctgtaccctgcaaagctatgggggtggagcttcccaaggctgtgggagcctgccttttgtatcagggtgacctaaatgtgagacacggagtcaaaggagaacattttggaactttcaggtttaatgactgccctattggatttcagacttgcatggggcctgtagcccctttgttttggccaatttctcccatttggaatgagtgtatttacccaatgcctgtacccctattgtatctaggaaggaactaacttgcttttgattttacaggctcataaacagaagggattttccttgtctcagatgagactttggacttggacttttgggttaaggctggaatgagctaacactttgggggactgttggaaaggcatgattctgtttttaaatgtgaggacatgagatttgggaggggccatgggtggaaacatatggtttggctctgtgtccccacccaaatctcatcttgaattgtagtatattgtttgtaaaaattcctgcctatccagagattttttaaaaaaaaacaatactttcttcaattttctcttacaatttaattttttacatttaactttttaatacttcctgtagactaaaagttattttggtgcattgtgtgaaccaaagatcaaagtagttttatttttttctgaaaacatctattcattttttcaattaattgattgtttatattaaggatctaggaggatctaaaattatggaattgtgggcaagggcaatttttgccttacatttcatgtaaggcaaaataatccccatgtgtcatgggagggacccagtaggaagtgattggatcatgggggcaggttcccccatgctgttctcatgacagtgagtaagttttcatgagatctgatggttttataagcatctggcatttccccttctgtcacctctccctcctgccaccttgtgaaaaaggtgccttgcttccccttcaccttccaccatgattgtaagtttcctgaggcctctccagccatgtggaactgtaagtcaattaaacctctttcctttataaattatgcagtctcaggcagttctttataccagcaggaaaacagactaatacagaccctaaatatccaaagcagtcctgagcaaagagaacaaagctggaggcatgatgctactttatttcaaactatactacaaagctgtagtaaccaaaacagcatggtactggcataaagacagaaacatatgccagtggaacacaacagagaacccagaaatgaatccacacatttagagccaactcatttttgacaaagtgccaagaatatgcattggtgaaagaatagtctcttcaataaatgatgttgggaaaactggatatccacatgcagaagaattaaactaaacccctatctctcactgtatacaaaaattaaatcaaaatggattagagacttaaatatacaacctgaaagtatgaagctactggaagaaaacattggggaaatgctccaggacattggtctgggaaatattttatggcctgggaaatatcaaaagcacagacaactaaagcaaaagtagacaaacgggattatatcaagctataaagcttccgcacaacaaaggaatcaattaacaaagtgaagggacaacctacaggatgggatgaaatatttgcaaactatacaactgagagggtattaataaccagaatatataaggaactcaaacaagtcaatggcaaaaaagcaaaggatcctattaaaaatgaacaaagatctgaataaacatttctcaaaagaaaacatacaaatggccaacaggtatatgaaaaactgctcaacatcactaattaccagataaatgcaaaccaaaagcacaatggatatttcactccagttaaatgacttttatcaaaaagacaaaaaataatgaatgctgatgaggatgtggcaaaaggggaatgcttgtacactattggtgggagtgtgaattagtacagatactatggaaaagagtatgtatgttcctcaagaaactaaaaatagaacgaccatgtgatccagcaatcccactgctggatatatatccaaagacaggaaatcagtgtatcaaagagatagttgcacaccaacatttattacagcaccattcacaatagctaggatataaaatcaacctaagtatacatcaacagatgaatggataaagactgtgtggtatatatacacaatagactattactcagccattaaaaagaatgaaatcctgtcatttgtggcaacatcgatgagcctggatgtcactgtgttaagtgaaataagccaggcatagaaagacaaatatcacgttttcacttacatgtgagagcttaaaaagtggatctcacggagatagagagtagaatggtgcttaaaggagtttgggaatggtatgggggggtgggatggaatgaagagaggttgattaataggtgtaaaatgaaggggtggcctgcccctcgtcacccacagtgacgagaaacactgtgggtgtttctcgtcaggtgggacgagagactgagaaaagaaataagacacagagacaaagcacaggaaagaaaagtgggcccaggggaccggcgctcagcatacggaggacccgcgccggcactggtctctcagttccctcagtatttattgatcattatctctaccatctcggagagggggatgtggcagaacaatagggtaatagtggagagagggtcagcaggaaaacatgtgaacaaaggtctctgtgtcataaataagtttaaggaaatgtgctgtgccctgatgtgcacgtatacaaacatcttggtgcattaaagagcagtattgccactagcctgtctcacctccagccttaaggcggttttctcttttctcagtaaatagaacatacaatcgggttttacaccgagacactccattgcccagggacgagcaggagacagatgccttcctcttatctcaactgcaaagaggacttcctctttcactaatcctcctcagcacagaccctttacgggtgtcgggctgggggacggtcaggtctttcccttcccacgaggccatatctcaggctatcacatggggagaaaccttggacaatacctggctttccagggcagaggtccctgcggccttccgcagtgtattgtgtccctgggtacttgagattagagaatggtgatgactttttttattattattattatactttaagttctagggtacatgtgcacaacgtgcaggtttgttacacgtgtatacatgcaccatgttggtgtgctgcacccactaactcgtcatttacattaggtatatctcccaatgctatccctccccccaccccatgacaggccccggtgtgtgatgttccccctcctgtgtccaagtgttctcattgttcaattcccacctatgactaagaacatgcggtgtttggttttttgtccttgtgatagtttgctgagaatgatggtttccagattcatccatgtccctgcaaaggacatgaactcatccttttttatggctgcatagtattccatggacaagcatactgccttcaagcacttttttaacaaagcacatcctgcatagccctaaatccattaaaccttgactcaacaccgcacatgtctctgcgagcacagggttggggctagggttacagattaacagcatctcaaggcagaagaatttttcttagtacagaccaaaatggagtctcttatgtctacttctttctacatagacacagtaacagtctgatctctctttcttttccccacagtaaaattacacttaaatagaagggataagttgtagtgttcgatattacagtagggtgactatagttaacaatgatttattgtatgtttcaaaatagctagaagagaagactgggaatgttcccaacacaaataaatgacaaatggttgaagtgattgatattccaattaccatcatttgattattacacattgtattcatgtatcaaaatatcacatgtatccccaaaacatgtacaattatcgtgtatcaatttaaaaatacatcatgataggcacctctcaggttgactgtactgtcctgattattgctagtggtgttaacaaatttgaagctagtatctttaagaacgggcagacccatgagcatgcccttctggtttacacactggaagtgaaacaactaattgttggtgttaaaaaatggatttcactgaactatgccatcgccaacagagctatgtggaaatcaataaggaagtcagccctacattaagaatactggctacaaccgcaacacagtagtatttatgccaatttctggttggaatgctgacaacttgctaacatgccttggttaaagggtggagagtcacctgcagagatggcaataccagtgtagcacaccgcttgaagctctggattatatcataccaccagctcatccaactgacaaggcttgtgcctacctctccaggaagtctacaaaattggtagtattggtaatgtctttgtgggcctagtggtgactggtgccctcaaacccagcatgattggtcagctttgctccagttaacattacaactgaaataaagtcttttgaattgcaccatgaagctttaaatgaagctcttcttggggacaatgtgggcttcagtgtcaagaatgtgtctgtcaaagatgtttatcatggcaatatggcttgtgacagcgaaaatgactcgccaacggaagcagctggcttcctgaaccatccagcccaaatcagtgctggctctccacctctgttggattgtcacacagctcacattgcttgcaggtttgctgagctgaaggtggttgatttccttctggttagaagctggaagatgacccccattgtgatttttattgctatggtttctttctaatttagtcttgaggtctctcccttgagaatggtcataagccaagagagccactttctaggagagtcctgaccagggggaaagttaagtttgagtgtgtcagcttggtgagacacaatgaggaagtaaaaacaaaataaatagtggaatagaatactaacaagtacctagaaataagtctagctaaaaatttgcaaaatgtctatggaaaaaaaaactatggaaatttactgagaaactttaaagagtacctaaataactttcaagatataccacgtacatgaattggaaaacatgatatttgaaaatgtcggttattcccaaactgatttatagattcagtgcaacctgaatgaaaatcccaagacgttccttttgtagagctcaacaagctgattctaaaattaatatgaaaatgtaaaggtttatgaatagccaagtccttcttgaagaggaagaataagatgagagtaattgctgtctaatatattgagacttattttaaagctataataattaaaacaatgtagcagttggtatagggataatcaaacaggtaaatgaaatagaatagaaaatccaaaactagtctaacacatatagaaacttgatttatgacaaaggtgtcacagaagtagagtttcaataaaatgctggaaaatgttggtatctatatagataaaacattacattggattcctaactcacaccatacacaaaaatccattcacattgcattacaagtctaaaagtgaaatataaaatcataaacattttagaaagaaaatgtaaaagaatatatcaataaccacagggtagggaaagaaagagaattgacatcaagatacaaaaagccctagccaataaggtttttttttataaattccacacattaaaattacaaacttatgctcatcaaaagataacataaaaacaatgaaaagattagccacggaatggtaaatgtttgcaatacataacacaaaggacacacaaaggaaacttatataatagattttaacaggcttctctgtgtccttcttctccagcaatcaaggaatatataaaaaagcatatcaaggatatatagggtactcttttgattcaacaagaaaaaagcagattatccaagagaaaacttggcagaaaaaagcttggataggtgctccacaaaagaggacatccaaatgactgctactcataagaaaagatgctcaacctcatagaacatccaaaaatgtaaaaacacagtcaataccagatatttgtaataatttggagcaaatggaactctcatacattgctaatgaaaatggaaaatggtccagctgctttggaaaacagtgtggcaatacctaccaaagccaaacacatgcatacctagtaattccgcccaacagaaatgcacatatatgttcaccaaaagatatgcaccagaaggttatagcaggtccatatgaaagtgccaaagattataacaactcaaatgtccgtgattagggtatattcatataatactatacaacaatgggaatgaacaaactatagctacatatgataatatagatgaatctcacaaccagaatgctaagtgaaagaagaaacaaaagaatatatgtagtatgttttatttacacacttcaaaacaggcaaaactaaactatatttttaaaggatgtatacgtaactggtaaaattataaagaaaagcaaagaaatgattatcataaagatcagaatggtggttaccttcagtgggaagggagaaagtatgattgaaaagggacatccagtgagtcttgtgggttgttggcaatgttactgatctgggtgatgattgcatttatgtaccaaaggcatttgtgttttatgcactttattgtatatgttttagttcacaatttttttagttcacaattttaatagggctttaaaaagtaaaaagaaaagagatccaagggcttgaccatgggactctcttatatttggagtatgtttataaactttacattcattcaacattcgacaaatattttttgagcacctactttgtgccaagcaccgttacaggtgctgggaatacaacagggaacaaaacagacaaaaccccagctttcatggaacttacatgctaataaagcttggcaagagtatttcaaggaagatgaagtggttaactatgcaaaatgcttctcaggcacctaggaaaatgaggatgtgaggcatttctacccacttggtacataaaattattgcttttcctctgctttttttctccagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtgagttaaggacagtggaattacaagaaaattaattttatatatttattttcttgctgactataatgtattcccacttttggaaatttttaaagtatagaaaaataattccataattatctttgtgtacgttctatttttcctatgtatttttctccttatgtattcaaattataccatgcagaattctgattcttgtttttttactaaatatcacatcataaacatttcttacgtcattaaaaacacttcctatgtatgtttttaaaatactgcataatagtctattatatgaatttatggaaccatagtttatgtaaccatttattttgaacaagcttttagacagtttcttttttcactatataaataacgctgtaatcacaacagtttttctaagataaaattccagaagtgcaatgtatttgagcatcttaagagtttttcttattaattatttggtaatgtcccttgcacatttgtctttcatggaggaagtgcttttcttattgattatgttaccttatatattagatagtaaaccactgaacattttaatgagaggtactttttcaagtttttgttttctcttaattttataaatgatggtttttgaaataaaacaggttttaatttttaggtagtaacccatcaatctttactttttgacactttcattgcttttatgtttataaaaattcctgcctatccagagattttttaaaaaacacctatactttcctcagtttttctcttacagtttaattttttacatttaactttttaatacttcctgtagactaaaagttattttggtgcattgtgtgaaccaaagatcaaagtagttttatttttttctgaaaatatctattcgttgtttcaattaattgatggtgtatattaaggatgtagaaggatctaaaattatggaattgtgggcaatttttgccttacattttattttactttccattatattctatgataaatatgtataatttttaatctggaaagtaagccttttttaaaagataatatgcattcattctagaatttgtcatgaagaaccttaacttacatatcaactcctggcgttatggtctcttataacccctgcagtaacattttcccttttactctggaatggcttttatgtgtttaggaattttctcctttgcaactttgagttcataccttaaatttagaatacaaaacctcctcaggattaggtttgagttctaacagcatccatcttctgtaccacttcttccagggtattaaaaactttgataaagaccaaaagacaggtatttcttttagggatgtaaaccctaaggaccttaagatcctagaagattattcttgcttttttttttttgtcgttattgttctacaggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggtaagcaggtgtctattgtgctgaccactttttggtttaaaagaaatggtctttgtgtactaagaattttgatatttatcctacgtgcaataagaagctttaaataggagagttgatcattatatttgtgttttagaaatgtcattctggaatctactgaagaggatggattatatttttggaaggtgggaggcaggttggactggcataaaaattgatgagaaatccactctggttcataggtgagagagcttatactcataggattgatgtcttccctccctaggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatggtaatatattccacatccaaacattatcactgtgaaatgcagattgcactttgacaaatgagacttgatccagggacttgaacattgtatttatttagagtatatctgtgggagtggaatcctcatagatgtcagtttttttggtggagtggagagaaagaaacttatataatagattttaacaggcttctctgtgtccttctccagcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtatgagcttgtttgtgctctttcttctacctactctatttgttgagtacttactttaaatggtctaggcactgggaacacaatcagtgatcaaagcagacaagctccatgctcttaagtaatactttttcaaatgctttttaaaccatttgttcaaagcaaatgaacaagataatttcagatatagaaaaattgctaaaaaggaaatagaacagaataaatggataattaatgtcacagtactttcctagggaaaaggaatttattcctttatcatttaccatctcaaatcccatagggcaccagtagtcatccaaagagtcatttgtttatgtatgtaaccagtatattgattaagcactactcataatgttgatcacaacacaattttattttggttcttcactgtccctttaaaatagatttggccaggtgcgatggctcacacttgtaatcccagcactttgggaggccaaggttggaggattgcttgaggccaggagttcaagaccagcctgggtgacaaagcaagacccccatctctacaaaaaataattagccagacatgtggtatatacctgtagtcccagctacttcacctacttgggtggctgaagtggaaggattgcttgagcccaggaggttgatgctgcagtgagctatgaaagtgccactgcactcaaacttggacaacagagcaagaccctgtctctaaaaaaaaaaaaccatccagtttaatagcgggggtaaactttccttatttcttcgtaaaaattctgataagccctgtaacttttctgctcacccttaagtaataaacaggactaaagtcactttatgtcacaaatacagttcaaatcagaaattacaatgtccatcccaagatattaatcaaaattgtaaacttgatttaacttcaatctcccctcctccaacttgagcctgcatcaggctggaagtctgcattggaaaagggagacatggttgagtcctctgtttctgtaccttgtgatgatcgtgcttccccacaacccctttatagctgctgttttgaactccaacatggataggttaaaggtaaggggataagatagttcttacctatttacagctggcaccattgttgtaaactagcttaacactgtttgtgcctggcaatacttgttgactctttctcctgcagggcactttcagggaactctttagagactcccttacgtgactgtcatgaaatccccttgacatgatttcttccacctttactctgggtggtcacttgtgactcatttctcagccctcagtgttcacctgcagcttcttgttgctggggtaactttacccttgtaggcagctctagtggactggatccagagggaactcaccctgacttatctgtttcacagagtccacatctggccaatgggaaacacaccttttgctcagaaagaccctgggaatgtaggtcaatcataatgcagtagcattctcctgtcccaaccatcaaagaattcagtcaccctgtttctcatctcctggggggaggggagtggtcagaactcaatctccacaacccccaactgtaagggtcacgtagcaagcactttgcatttgaggggtccaaaagtagtggaactaccaaatttggtaggtctactctgatatttcgcataaaccaatgtatctcatgctcattttttagtgaaaagaaataatttctgttcctgttggtttttataaggtgtttttgagacagtggaaatgttaccatccaaagctggaatttggcgggtggaatgccttattggcgagcatctacatgctgggatgagcacactttttctggtgtacagcaatagtgagtagcaatgtgggcagaggttccctacctactcagcctacttctttacagctttcttcctttctggaatggttgcttgtgtcaggaaataaatacaagtttacatcattatcaaatttaaaatgaatattgctggtagaaatcatcagagttctcagagtagggcagatatacttgaagctttgaacactttgtacctgaagctctaaataattgacaaaaaaaaaataccacctcattttcacaacttggtaaagctcgaagatctccagtagcagattttggaatttaatgttgatttagttaccagataacttagaaatactacttggaagagtttggagatttaaccctaaacaagtaagagagccactggtctatttatgtacggaccccagtttcttcagctgtaaaatgtgaatcattctagcacctgttaggattaattaaatgaactaatacagtaaaacgttgagtacagttcttggcacatttaaacactaaaaaatagcatttgttgacgttctcccattttcattgacttacatttgagaagctgaattttgtgcacttctagttactgtgttccacccgtttcatttcagagtgtcagactcccctgggaatggcttctggacacattagagattttcagattacagcttcaggacaatatggtaaatactattatttttgctccaagaacctgggctgattatatctttttttaataatctggtggagaatctcagataatgaatccatctccatgcttctattagttctattccataagtgcctctcaaatacatctcctcctctccacttcccactgtggccatcttaactcaggtcaccatcatttcttacctgggcaatgacactgcctccttaaatatcctccctaccttcagtatttcttccttgagtcaattcttttcagtgcagcaggaagctatactttcctatgagcagtaatggtaaagtttgactagggtctatagagaattctcagaaattgttttagagcactactgcccacaggctaaatgcagcacactgcctgtttttgtatggcatgtgagctatgaacagattttccatttttaaataattgtcaaaaagatgaagactatttcatgacatgtgaaattataaaattcaaatttcagcatccgtaataaagccttattttggaacacagccacgtccattaatttacatatcatctatggctacagcagcagtaacatagttgcaacagagaccatataatatgcaaagcctaaatgatttactatctggccctttacagaaaaagtttgccaacctatgttgttgtgaggtaaaaaaaaatcctcttgaaaaggaggcgtgagagttttacaccaaaatagtaacatttttcactaggtggaagggttacattttaaaatgtcttttatttgtatttttactaatttttacttttcattttctgatttttctacaatgaacatacattgcgtaataaataataggcggggcacgttggctcatgcctcccagcactttgcaaggctgaggcaagcagatcacctgaggtcaggagttcaagaccagcctggccaacatggtgaaactccgtctctactaaaaatacaaaaattagtcgggcatggtggtacgcgattgtagtcccagctacctaggagactgaggcaggagaattgcttgaactcaggaggtggaggttgcagtgagccaagatcatgccattgcactccagcctgggtgacaaagcaagactccatctcaaaaaaagaaagaaaagaagaaataatattattatttggtagtgttggtaacaaattgcagtatcagctagttagaggtgctaacaattaacaaaattataaattttagaaaataaaatggacaacaaggataagcaatatccttagatagtaattgatactggtatgccataaagcctttatgtttttctctattttcaccacagcttagattaacctttctcaagacaataattttattctcaagtgtctaggactaacccagctgaatttaatctctgtttctttacttgggcaaaggacagtgggccccaaagctggccagacttcattattccggatcaatcaatgcctggagcaccaaggagcccttttcttggatcaaggttagaaaatgtaatcaatgatgggaaatgtatcacattcaatcaattgcattacttattcctcttgcaagctcaaaggattctatgaatatgagaaaactaaagaacagaatgccttaatgatttgtacaaaagcagtcatgaacaaagagatatggggatagaattgagtatattgatatgtcctgtttctgtattttagtccttctactgggattagaacatctgaatattttctataatattgaactcgtcatctctcaagacagtatatgttattattagatgcttccaactgcccacgtgtccttaagtactccaatcccctttattttaacataaaacaaatggttcacaaatgcaaaccacatgtgtacttttacattttctgtagccacgttttcaaaaatgtgaaattcactttaataatacattttatttaactcaacatatctgaaaatactatcatttcaacatatgatcaatgaggccccttcaaagacagacagatggaaactcttgggtctcttccatgcctcacaaaagctgagggcagcttggaagtgcctgctcagcctctccacctaaacataaggctagatgccttctagaagcccaaacaggaaatggagaaaacattttggtttccatctttgcaaatagcatgtctattaatgccacagcattgttttgtagacactgccaattttgactcaatctgagctgctgttcactaatccctaagtattttttgttggtttgtgcttctgccaaacaacatgttatgttcttcaccttgtatttctatggttattttcaaccttaagtgtatccctatatagagaacatgtttatctatttggccaccctgtgtctgtctgtgctatttaattttttgtaataacattcttatttgggagggcggaattatatcttcctcactagatacaacctgataagactagtaaatagagtgtcctgtctgtgcctagccaatgaaccctgaatgatatactctgttgtttccacttactagatttggcccattgtttcagcttgccgatcttcagtgtcccaaagtatttcctagtttttccagttactgatttgatcagtaaactttctaatactgcagcaaagtcatgatcaaaatattgaagtagacaagacttccttagtatgtgcacaatacaaatcaagctgttaagtccttactacaaccttgtgaggtagatgttactatcatcttcatttcagataatgaaattgaagcatagagaggttattgtggcccaagtcacatggctaataagtgactgagccaaaattcaaattctgatagttgggctccagaaccctaactggtaatcgttgtactacactgtttccggaatgctccctttaagttgataaccatctattaactgtcactgttcacttgtggtaattaaaccagttacaaatccacctagttatgttatcatctaccactattgaatcgccttatcttcaaggtggttttgccatctgtcctactaaggtccagctagactttttatagatctcgtaactttataaaataaaccatggagatggagttgaaagggggtgctgacaaggaagggagttggagaaggcatctattctcgtgagaaggcctgaagagtgcacaacagcctggccccaagacacaagagcactgggctggcttgaggagcaccaggtgaccaagaccaggcaatgcacagggggaagtcagcaggccccatggagatacgcagctgcagtgtttgtacttttatacagtgaaactcattaccaccttgcttacttcctagtagagagatgtgtcttgtagttacactgaaacacctggctgggcacataggtgaagctgttgagtctgtaattgtcaaactgctcccaggtgccaattataatgtagaagaggcacaagaagatgaagtggataagcctggcagtttgtcaagcattcatcagttgtcaagcatttgtcagttgcagaatgtaggtaggctgccaaggctttattgtagcctggttctattgcagctttattctagcaaggctgctggaaaatacaataatcactggtccaagaaagaactcttatactctatctatatgaagaaacagtaaaagtcaattcagtagaaatcatgatttttgtgcctggtgctttcacttttttatgccacaataccaagaggttaaaatgaagtgtctttgattgggaataccatctatctgggaaaagacagggctgcaacttctgaagaccttgacactctgtcctgttaccctgcttcatttttctcctgcgcttatcactacttgatgctataaacaaataaaaacatatatgatataaggtctatttctcctactcaactgtaagttccatgagggcagggctttctttcttgtttactactctattccctgtatctaaaacagtgcttggcacatagcaagtgctaaaaaatattctttgaatgagtgtatgaatggaacttacagtcagctgaaggagacagttattaagcataagagtgatgaccagtccaattgtgtgtgtcaggcatgtgtgaaaacgtgctaaatttgacttgcttattaggacagtaactgatacttctaatgttcttgcagcccatgacctcttctttaagaagtgtccattctgtactactttcccattattcactcattcattccaaagcatttgctatacagcagtattataccagataccatattaggtgctggggctagagagaatataaaagctaacattgattgagtgtttagtatgcgccaggccctgaactcagcacattacatgtattaactctttaacccctatggcagccctttgagataaaaactaatattatcttcactttacagataagttgagacacagaaagttaggtgactcaaatgggttcactgccttaaggatctcagtctaataaggaaagcagaaaagcaaagcaaccttataatatggtgcaataatttgctataatgaagttatatacaaagtgaagtagaagcatagaagaagcagcactaaatttgtctgggtgagtcagagaaggctaaccaggaaaaatagtttctgaactaacacttgaaggaggtgtagcagttcatcactgacagtgatgttggggtgggtctggtttcaggagaggggaggaaattggctttggtctgaggctgaggtgtgggcaaagcattagcttatgtgggtccattagcttatgtgagtccacaaaaggtgtgtgtgtgtttgtgtgtatgtgtgtgtgtgtgtgtgtgtgtgtgtgtgtacgaaatgggggctcaatgatttggtagtggtttggtttgtcaagaagcaggctgggaactcaataagcatctttccattcatttctactgtgtatcccacagcttcacacacacatgcacatttcaacattggtgactgcttcacttgcacacctaaggtaatgatggacacacctgtagcaatgtagattcttcctaagctaataattagtttcaggaggtagcacatacatttaaaaataggttaaaataaagtgttattttaattggtaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtatgtaattagtcatttaaagggaatgcctgaatactttaaagaattttggcagatttcagatattggacaaacactcttagcttccacaaacttaattccaaaaaataatttttcacttatgagcaatagagttattacggacatatcagcaaaaatgtagtagtgtcaaggctcatagatgatagaaatgaagagatgctgtattgatagaaatatgtgattcaggactgtgtggattgatgattgtgagcttgcttatggatatcctaggtttgaggttatagtaggacaatcaggttgaaatgtccagcaggcagtaggtgaaagacaagtttagggggcaaaaccatggatggagatgaagattcatgacttccacataaaaggatgggtgaaactttgggaattgatgaattctctagaggtgagctcaagacccttaaaggcttaaaacctcagcgttattgtctactcttccctcatttttatgcccacaaatctggtcaatcctttatttgcaatgcctctcacatctctttcttctgtttccatttataccgctgttgccacagcccagggtcccatcacctcacacttgatctattgtattacattcctaactagtcttcccccgtttctaatctgttctccgataaaagctgcacatcattttcaggataatcatcagtcgcctgcctaaaacttttcaatgtcttcccattgtctttagaataaagttcaaagtcttcaaatgaccccaagcaagataacttttgtttgcccctttagatccattttcctgcttctctaccctgcttcttgttctgtgaggtgagcttgtatagaatacatcaacaggttaccttgtcctccagcttttggttggatttcaccaacagggagcactggcaaaagattggcatatttattcttctgactttctccttgcagaggagttcactgtatctccccacttaaggtcactgtttccctcagagtggctttttctacctgtactagctactattgctgtgtaccaagccacttcaaaacttgctgtcataacaataaccattatgttttgctcacagattctgtagatcaagactgggacacagtggggatgggtggtttctggagcctcagttaggattatttaacagctgggtgctggaatcatctggaagttccttctcttgcttttctggtggttggtactgactgtcagctaggacagaatctggggttgttgactgatgtaactttacatggattatccctgaggcctggccttccttacagcatgtttcaaggtagttggacttctttttgagggggggtaggaaggtggggggaggacagagtctcactctgttgcccaggctggagtgcactggtgtgatctcggctcactgcaacctctgcctcccgggctcaagtgattctcctgcctcagcctgctgagtagctgggactacgggctcatgccaccacacccagctaatttttgtatttttagtagagacagggttttgccatgttgaccaggctggtcttgaactcctgacctcaggtgatccgcccacctcagcctcccaaagtgctgggattacaggcacccggcctgtagttggacttcttacacgtcattttagggcctccaagtgtgagtgttacagttaacaaggtgaagactacataaccttttctgaccgagtcttctaagttatgtagcatcacttttgttgacaaaaagtgttgaactctataaaatatttgaagagatttattctgagccaaatatgagtgagtatggcccatgacacagccctcaggaggtcctgagaacatgtgcccaagatggtcagggcacagcttggttttatacattttagagaggcttgagacatcaatcaaatacatttaagaaatacactgatttggtccagaaaggcgggacaactcaacctgggggcttccgggctataggtgaatttaaacattttctggttgacaattggttgagtttgtctgaagacctgggattgatagaaagggaatgttcaggttaagataaacattgtggagaccaaagttcttttgaagtcttatagtggctccccttagagacaatagatgacaaatgttttgtattcagatcttagttaatctctttaggattgggaggggctgggagaaaaagatctagctatgttaatagagattctttacagttgcaaatttccctccacaaagaacagctttgcagggccatttcaaaatatggcaaaaaaacatgttttggggtaaaatattttgattttcttccttgtctcataatgttatgccagagtaaggttggaaagtaaatcatgacatataaggttaaataaaacccatctgatgagaatttatgatttgtagggcatgactccccagaccccttagataggaatttgggcaagataaaaaaaaatcagagtttagtcctcactttcaatacattctattggttataagcaaatcgcatatccacccagattcaaggggaagagacatagaccctaatttttaatgggagaaatgttaaataattggtggtcattttttaaagccactacaataatctatccaattctctctttcaggatgtttctctcttctgatcctttcaggtttagggattgtcaacaaacaaaaagttaaaccctgtaaaatacttgaagagatttattatgagccaaatatgagagaccaatggcctgtgacacagccctcaggagatcctgagaacatgtgctcaaggtggtctggctacaacttggttttacgcattttagggagacataagaccgaaatcaatagatggaagatgtacattcattgagtttggaaaggcaggacaactggaagcgaggcggggcttccaggtcgtaggtagattcaaagattttctgattggcaattggttgaaagagttaagttattgtgtaaagacttagaatcaatagagaggaacatcggggttaagataaggggttgtgaagaccaaggttctgtcatgcagatgaagcctccaggtagcaggcttcagagagaatagattgtaaatgtttcttatcagacttaaagagtctgttctatcagtctgaaggtctgtgttgatgttaatgctggtcagatttttctgaattccaaaagggaggcgggtataataaggcatatttgatccccactttcccatcatggcctgaacgtttttcaggttaactttggaaggccctttgccgaaaggaggggggattagaattttattttgggtttacaggatggtaatactctgttcccaccctcctaactagtatctttattaaaccttccacaaattatcctaatttccatgttttctgttccttgctggatcccttgtttcatacagtaattggtgctagaagaaaccccaggaaacagattttcaaaatgcaattctaaggttatgttgctaatatattcaagaaacacagagataacatatttgccaaggaagaaaatgagcagttagggaatccatgacatgtgttagtattatagtttctcagattatcaccagtgatactatgggatgagttgcagatggcaagtaagacactggggagattaaatgacagtggcatttagtcactgtggcaacaaacgtagcattacctgattgtagagtggtctgtcttcttacagccctagagggcatacacatggaaaaagaaatgaaatgttatgaatatatacaaaataagaacactgatgaacatacatggaaaatcaggatgcatgcatagagcttttgaggaatactccgtatcctgtggttgtaggcagatacgacttaggggctgagcataagttgcagagctgcagtgacaattaaatgcttaactccaccagatctattatgctgtggtaagagtaccggtgggaaggagtgaaactctgaggcctgagatggaggcatttaggcagacatggatgaggctgagaattgcaaacctccaaattcccctgaacctcctttgcctgaggaggcaaccactccccagtctctgaagcagtcatccctcttttgtgtaaaagcctttcagtggctataactgagataggtgcctcacaaaccagtgactattctccttagagaccctgtttggacactacgaaagccaggcgagtcacagaaaatgacagcagatcacaaatttaatcaggtggtgatgccaaaaaacaattgcaattccagatatcatatctctgttgaagcaaatttacacagccccaggcacctgatatggaagtattgacctagagaatgttttttcttcatttccatacattagtaaaatcagaatacatttgaatttaccaagtaggaacaagagtattaagtttactgcccatgcatcagggcaatgttagctctcttgttttctatcataatatagactcaagggacctcaaacatctttacatcccacaagcacaatgcctgtccattacactgatgacattatgctgacaggatctggtaaacacataacaaataagcctgtcttgctcttgactttaatgagaatgtaacctgtgtttcactgtttaatataatgttcactgttagtttcaaatactttttatgatgtttaaaaagttttctcctatccctattttatttgcaatggcaactgaattttatcaaatgcttttccagcatctttgacatggtcacatttctcttttgtgttgtcaaattatacttaacattcaatagtgtgctgacaagaaattaacaacccacaggggagcaaagtgagaagaggttaagaagtaaaggccttgatttatagcattggcagatttccctgacataaatactactcccatcatgcctggccccagggatgggaagagatgcttacttacaattggctctcacagaccagtgcaagagcactactgtgctccatttctgggaaaactttcgtcagtcatagtgtgttagttatttaaaacttagctggatccaatttgccaacatttcatttataatttctatatctatattcatgaatgaaatgggtttagctttttcagtagctctacttaccaggttttggcatgagggttatattaaacttgaaaataaagtgggaaagcttccatttttttccatgaagactattgctctagaatagcttatttaatgtaggaatccagtatttaatgagagtaaatgaaaaagccatatgagccatgtgctttatttagtgagagatactaggctatattttccaatcgttatatgattattgctattctcatttgtgttgccttgagttaatgtctgcaaatgtgcacattagagtcatatatcccttcctgtgccatacatctatatctgtatacacacatatgtcttttctccttttttcccttctgtatcaagagttggcaagtgtttgtctattctattaatttttcaaagaatcagctcagttttaaacccaaacgtggttttgaaagagctgtttctagttcatcaatctctgttcaaaactttaaaaattctattttcctttcttttggtttgtttcctacaatctggaggtgaatgcttagttcacttattcttcaatctttgtattttaacgataaggataaattacttacagttattaactactctcatgaggttcattccttgaacagtcactgagcaactactatgtcctgggttctaattcaggggtgggcaaactatagccccagaatttggcccatagcctgcttttgtacggactgtgagttaagaatagtttttacacgttgaaaggattgcaaagacaaacatacaaagaaacaaagaagactgtgcaacagagaccacctgtggtctgtaaagactaacacatttctatcccgcccttgacagaaagagtctgtgggctgctggtctcctctaacggtggtagagatgcctgcacggttaacattaatccttggcaccagaatcctcagcacctaggaaccagatcttgcctaacacgctaatttcagtcttgaccaccttcctccggcgtagcggttctcaaacgtctttgtctttgtactattcacgtataaaatattctttcataagcaacatttatccttttgggaatacctcacaatggggagaaggggaaccccaacagcctttaagggttcactgcttcgctgccaccatttccgacggtttacactgttttaagtgtgaatttggaattgttttcaagttaaaaagcaaactaatcatgtcctctgaaagtatttgcttttggcatgctagaaatcagtgttgacttttgatactgatgtgatacattacgagggaattctcaaaactgctgaaatctggcctcggcccagttatcactgctcttaagcttctgagggagatacatgaatgagcccacggcaaatggaaaacgaggagttttagtgtttcctagaattatgctcagatacccactacctgaccgtctggttatccttcccctcacctccctgacgcaaggagtttggaccagaggcctaaggaggcttctcctgaagcccaaatcccaaactggtcaccagtcatgctccgtaactcctgaacctgacaagaagccagccggccaggtctgcagcccgggttaagaggagcataccaggaaagagccaaagagcaaaggagcatgagcccttcaaccgcttttacaataatttgggctaggcgttcagggctccgtaggacccttcctggcagccaagtgagagaaagaggaatgatggtggaatgggcctctcctgtgcttcccattacttccacactgtcgaaatagaaatagaagcagaaaagaacaccctacaagtcccacccatttggaggcactcaactcacagtgacaaccctccacacctctcccctgcaaaaagacgcaaaacaaaaacacctactccaaactgtgtccttacatctcagccccgaagatcaggattgtgtgcaacttcggcccaaaggatgcatttccccagggttgaaagtttgagaaagaggctatattctgaagagttcttgttgtcaccatcaaaaggattaaaaagacgcaataaataagaaaacagcgtagttggggggcatgctccatttgagccagaaagccttggaaacttaagtgttctcaaacggaacgccatcctgctttgggggaacacggaggctgccttgcagtcacgtgatcgcacaacaccaaagggccacgcactctgatttcacctacttaactaaaagttgcagcaaaatccctattacaggccaggcgtggtggctcatgcctgtaatcccagcactttgggaggccgaggagggtggatcatttgaggtcaggagttggagaccagcttggccaacatggtgagaccccatctctattaaaaatacaaaaattagcccagcgtggtggtgcacgcctgtaatcccaggcaccctggaggttgaggtaggagaatcgcttgaacccaggaggcggaggttgcagtgagccgagatcacgccactgcgctcctgcctgggcgacagagtgagactccatctcggggggaaaaaaaaaaaaaaaaaaaaaaaaaatccctattacaaataaaagctgttgtgatccagactgcatatacctctgcgaatggaaccagaaccgtgaattccaatgcaaatcgatgcatcggcaccagacccgctgcactggatgtatctgcattgcagtcacccgagtacggagcacatcatagatgatctctgcaggttcgttgcccacataggaggcatagcgcaaatttcaaaggaacgaatacatcctggagcccaaacagctatctggttctgctgctggcctcctgacaagtaggtaagagagtcacattttatagacgacggacaccaaaaccacacatgaggagtacaagagtagctttatcatggatttagggctgtggttacaaggaagctgtaaggaataaaatgactcccatgaagacgtaccgtgcggacgagtggaaggagaaatttggccattacaaagacacaggaatatgttaagaagtgaggggcaggatgaaatcatctagggtaggtatttagagggagggcgccgtgcaaaataaaatcctcactatgaaacaaaggcggaggcaggaggctgcgttaggtggaagcagcggaggaaggagacgaaagggattgtcattttcatgtcgtggctttttagaagacagccatgtcctctactctgattctatcaaaatgtgttctcggggtgctggtaacgttcagccaacgaaataattcctatggcggcagtaggaataacaaaacgcagaagcgggaacgatgtctttttattcctccccagacgcaaacgtggatgcatgaggtttggtaacaggcaaagtcatctggttaacgtgactgatgcaaaaagtccaggcctgggcaaaaagaagtcactgggtgaatgggatggatcagactccctgtcctgagggggagatggtttcttgcagaacgaggtgaaggaggtggttctgctcagcagtcaacagtggccacatctccacctgcagcgacttgatggcttccgtgtccttttcgtgggtagccatgaccaaagactggagcagcagaaagagctcctcgggaagctggccgctgctctcctgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcgggagagggcgccgccgagccggagttcggaggaagcagcgcggccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtagtcgcgcgccagcagctggcaggaggcggcctcgccaagcgcctgcagcgcggccaggggcagctggggcagctggagctgggcggcgcgctggaagtgaccggcggcggcggccggctggcccaggtcgcgcagggcggcggccagctcgaggcagagggcggcggcggcggccggctggcccagctcgaggtgcagacgcaccgcggcgcccagggcgctggcggcggcctgcagcggctccccgtaggcggcggggcagaccaggcgctggcgcgcgtcgcgctcctgccgcaggaagaggcgggcggcctcggtgagggccagcgcctccccgggcccgtggaagagcgcctgctggcagcgcgccaccgccagctggcaccaggccgcgtagggcagacactcctgggcgcgcagctcccggcccagctgtccgaactgctcgccggcctccgccacgttcggcttccgcaggaaccgcttcttcagcttgttcgataccagccggtagcgggccaggaagtccccggcctcgggtcccgggccggcgccgccgccgcccaggcctgcagccgctgccgccatgctcgccgccccaagcacttcccgacgcgccgccgcagctggcgggcgggccggggcggggcgacgtgccctgcgtccccctcggcgggctgccgccgtgcccgcgccggctccccagcccgagcctgccccttgccctgatgaggtgcaaagagcgggatcggaggcggggcctggccgggctgtgagcggcgtatgcaaatcgagggtctcggggatgcggatccaagaccctgggaaggtacgcggggcctggcggggcaccagctgctgctagctcggctgcaatgcaagtggtctaggttgctaaaggcatcccacagcctctccatctgaacatgacccaaacgaaactcgtgaccctaattccatgtctgcgcatttctagactgttgtccccccccccccccgccccgactactcagtcctccgtcttccggtccagggccccttgccaagcaccgggtccacctctccgtccccaccccggttgccttagaagtccgtcctgtcgcaacactgcagtcatggtcttgaggcccacccgccccaacgaacaccatcatgctgaggactttcccgggcaggccctgacttgctcagaaccagcgggggtgtccccttcccacccagggccactcccctgcactgtcacccggagagactgctcctctgtgccatccctggctcccacccaaccccagacccccaccacctctccatccctccagctgtggaggtctcacaaccccccaacccatctcaccgcccccccacccccaccccaaggcaaagtgactgaagcgggcagatggcttccttgaaacattttattgacagaattaatgaaggcccaagactttggggcctgggttgtggggggagggtgtttaaggccgggggttcaggccgggggatttggggccgggtgggtggacgagtggacctgtcaggtcccaggggccgggtgtcagaagctagtcctcgccaggggccacttgagagatggtggtcgtgttgaaaagggtgctcagtagcctgtcgttgtgaaccaccatgtccagcagcaggggagtgatgttccgctctccgctgttctgggcctcgttgcccgccagctccgggaccttggccgtcaggtactcaataaccgcagcgaggtagaccggcgccgtgcgactcaggcgctgagcgtagtggccctcccgtagactgcgctccacctggctcactgaaaacgaaagctccgctcggacggtgcgagagcaggtccgcccccggccgccagcaccggaggaccctcggcgtctcctcctcctcggcatgctgggcgttgagtgtgctatctcggcttggcccagctaggcaagatggctctcaagaggacagttaccgcgtccagtactgtgtatcctagcgaccagggcccagcccctcattggctagggagccgagaccaatgggcacgcacatccggcgacgggcacgcatgtggtgacggcccctcacaagggacacacgtccgtcaggtgacctcatcactttcccattggcctcgagggagcaggcctgggcctagaagtggctggagggccgtgggggtggggtggggcggggcagggggaatcgcgctggtgaccctctctttgccagtgggaactttccctttctactggatgggaacaccgtgggaaagacaaaggggtgggcgaggggaggacgggtaccacgccttcacaatgttgcacatccatcacgaccacctagttccaaaacgttttcaacaccccgaaaagaaaccgaaacccctgtacctataagcagtcacttgccgcacgcctccttccacaccaccactaccagcccccacaccctcccacacacaccccctgcccccgcccatacacacgttcccgatagtccctggcaacccctagtccatctgctttctgtccatagaggttagcctgttctggagatttcctatagatggaattatacgaccaaatgtgaggccgtgtgtgtctggctgctttcacttagcgtaatggtttcatcagggtgcatccatgtagaggcatgaatcactacttccttcctttgaatgactgagtacgattctgttgtatgaataggaggccacattttgtttacccactcgtcagttgatggacaggttatttcccccttctggctattgtgagtggcactgccatgaccatctctctacaggtttttctttgaatatctcttttcagttcttttgggtctatttctagcagtcaaactgctggctcgtgtggtaattctgtttaacttattgaggaaccaccaaactgatttccacagcagctgtaatctttcgcattcccaacagtagtgcatgagagtcccaatttcttcacagcctcatcaaaacctgttttctgtttgcctcattttgttttgtttacagtagccatcctactgggtgtcaagtgctatctcatggtggttttcattcgtatttcccaaatggctaatgatgttgctgtggtttgagtgcatcccccaaattgtgtgtcttggaaacttaatccccaaattcacatgttgattggaggcgcagcctctgagacggtaattaggattagataaggtcatcggggtgagacccccaggatgcgactggtggctttataagaataggaagagaggcctgaaacgacatacacgctcttgccctctcgccgtgtgataccctctgccgtccccagatgccgggtcacttcccagtccccagaacggtaagaaataaatttcttttctttataaattgttcagtgtcgggtattcaattatggcaacagaaaacagactaagacatcttttcatgtgcttcttggccctctgtacctctgctttggaggaatgtctattcaagccctttgcccattttttaattcggttgattgtattttggctgtgggcttctaaaacttattcatatattctggaaaatagactcttatcagatatgtgacttgcaaatgtttctcccattcactttctggatagagccctttgttgcccaaaagatttacatttggatgtagtccaacttgccaaatgaaaagatatctgtggctttgcctttggtgtcatactgaaggagctgttgcctaatccaaggtcgtgcaaagttacatctccgttttcttcttagagttttatagtttcagcccttacatttagatctgtgatccattttgaattaattctttacatgatgtgaggtaggggtccaggggccttcttttgcatgtggctatccagttgtcccagcgcagtttgttgaggggattattcttcccctccacccattgaggggtgccggaactcttactgaaaataaactttacataaatatatgggtttattcctgactctgagttctgtaacattgacctaatgtatcgatcacgatggcagtaccacccttttcggattactgcggttttgtagtacgttttgaaattgggaagtgtgagtccttcaacttttttcttttctgagattgttttggctatctgagccccttacattttcttatgaattttaggatcagcttgtcagtttttacaaagaaggcaggttggattctgacaggcatcacgatgaatctgtatattgccttggagattatgggcatcttaacaatattaagtgtcccaatccgttaacacaaaatgcctttcgatttatttaggtcttctttaatttattttagcaacgtcttgaaattttcagagtatacatcttgtacacctttagttaaatttattcctcgacattttattgtttcgatgctactgtaaaatgaatcatttccttaatcttattttcatgttattcattgctagggtgtagaaatacaaccgactgttgcagattgatcttggatactgcaactttgctgagccgaatatgctttgctgagcatactcagacagggttggcatattagtccgttcctacactgctataaagaactgcctgagaatgggtaattcctaaagaaaagaggtttaattgcctcatggttctgcaggctgtacaaggcttctgcttctgggcaggcctcaggaaacgtgcaatcatggcggaaggcgaaggggaagcaagcaccttcttcacatgttggagcaggaggaagagagagagaacgcacgcaaagggggaagcgctgcacattttcaaacaatcatcagatcttgtgagcgctctatcagaagaatagcaagggggaagtccgcccccatgattcaatcacctcccactaggcccttccttcaacaggtggggattacaattcgacatgagatttgggtggggacacagagccaaaccgtctcagttttttttttttttcttttgttggactctttagtgtcctctatataagaacatgccatctatgcatctatgaatagagatggttttacttgttcctttccgatctggatgccttttatttctttttcttgactaattgccctgactagaactttgagtacgatgttgagttacaagtggcattcctgatcttagggggaaatcaaccagtctttcaccattaagtatgatattatctctgggtttttcatggatgccctctatcaggttgaagaagtttctttctgttcctggtttgttgaatttattttcatgaaagggtactgcgttttgtcaaatgatcctttttgtacatgattaagatgaccatgagccccctcccccgcccccgctccgccatgcattctgttaatatggtgtattatataaattgattttcacatgttgaaccaaccttacatttgtgggataaatcctatttggtcatagtgtataaagagtggtcaataaacatttcgttgaaagaataggagtggatctggcaagcttcttggaggacaatgtgtgtgttaaagaatctgtagcatgatgagaagccaaggcaccggtgggaggaggggagttgcaaccaattcattaaggctggagagtacgatgccagtggagcagtagtggttgatgtggctgggaaagaggtaggcaggagccaagacatggaggttctattatgccatgctcaggttttagaataccctgtaggctacactgaacccactgtggtctttcagcttgggagtgacgtggtctgatttgcctctagaaatatcaccctggaagctgtgtggagaatagaacagagaggattgtgtgtggagaatagaacagagaggactgagattggaattagaaagctgctgtattataccagtcaagaaatgacagatatctcaactaagacaatggcattggtagataagactaggggacagagtccataaaaagtttaggtagtaaaatggcacacagtagacactcactacatattactcatactggtgaacctagctggagacatgataattcatgtgctcattcttcaaaaaatattgaagggtagtgccaggtatactgtgttaagcattgagacaacaccaacgagaaatattctgttgtataaataggccacattttgtttatctactcatcagttgatgaacagttcattaaatgatttccatggcaggggaggtaaatgttgtcctctatcctcttagattctccagctaggacttaaataagatagattaacaaaagaaaagcatacaaaattttatttggcattttttacatgtacatgggagccctcataagaaatacgaagactcaagtgattaattacagctgaatacttacatactagggtgggaaaagtatggtaaattgtgaaaacataacaagacattggggtttgggctaggagagttaattgtggaaaagtcactaagaaggtaagagttgtgtaacaaggttttttggtgcagctttccctcaagcctggactccccatctctggcaataagaatgtgtttcttcttcctggtatacagataatacctttcacatcagagtttcatctcttcctttcatgaaaaaaaaaggaaggtcagtgtgcccttcttgcatctgctactttcaagtgcctttaaacacaaaataatcaatatgccaaagtggcatattttgaggtggcatttgatcccctacattactgattggatagtgtgaatagtgctgccatgaacgctcctgtacaagtgtttgtttgaacagatgttttaaattgcagacgctcctcaacttgggatggtattatatcctgataaacccattgttagttaaaaccattattagtgtaaattcatttaatacagctatattagtccattctcacactgctataaagaactacctgagacttggtaatttatgaagaaaagaggtttaatggactcacagttctgcaggcttaacaggaagcatgactgtgaggcctcaggaaacttacagtcccagcagcaggtaaaggggaagcaagcacgccttaccatggtggagcaggagagacagagagtgaaggacggaaatgtcatacacttttaaaccatcagatctcatgagaactcactcactgtctcaagaacagcaaggggaaatccacccccatgatccaatcacctcccaccaggcctctcctctgacacacggggattacaattcgatgtgagatttgggtggggatacagagccaaaccatatcagcggctaacctaccaatcatcataatttagccaggcctaccttaaacatgctcagaacacttacaattaggctacagttgggcaaaatcatataacgtaaagccaaatttataatgaagtgttgactatctcacgtaatttattcaatattgcactgaaagtgaaaggcagaatggttgtatgtgtactttaagtacttttatgcatatggattctactgaatgcatgttgctttcataccatcataaagtcaaaatattgtaagtccaaccattataagctgggaaccatccatatttgaggtacatacccatgaatatatttatgggtttatttcttgcttcttaattctattccatttatatatatgtctgtccttatgccagtaccacaaagcattgataactgtagctttatacgaagttttgaatttgggaaatgtgagttatccagctttgttattttttaggattattttggctatttgaggtcttgcacaattacacatgaattttaagattggcttttccatttctgccaaaaaaaaaatggccattgggattttgatgcagattgtattaaatctgtagatcactttgggtagtactatcatcttaataatattgtcttccaattcatgaacacaggatatattttcacttctttatgctgtctctaatatctttcagcaatgttttgtagttttcagtgtacaagtcttttacctccttagctgaatttattcctaagtattttattctttttgatgctattttaaatagaattattttttattttgttaatttcatctcagattgttcattgctagtgtgtagaaatacaactgatttttgcacgttgatcttatatcttgcaactttgctgaattcgtttattagctctatagtgttttgtggattcttcggggttttccatacataagctcatgttcatctgagaataagatagctttacttattccttttcaatttggatgccttttatttctttttttcctaattgctctggctaagacttccaatacaattttgaatagaagcagtaaaagcaggcattcttgtctcgtttctaatgttagggaaatatctttcagtcttctaccattgagtgtgatgttagttttgggtattttatgaatgctctttatcatgttgtggattttctcttccatttctagtttgcttagtggtttttttttttttttttttttttggtcatgaaaaggtgctcagctttatcaagtgatttttctgcatcaaccagaatgaacttgcaggggtttttttccctatattttattaatgtggagttgactgggggattgattgtcttatgttgaaccagtcttgcattattgggataatttccacttgagcatgggctataacctttataacatgctgctggatttggtttgctaatattttgttgaagatttttgcacctagatgcataagggaatattatactcacatattcaattacatgcaatttgtaattttcttttcttgtgatatatttgtctggctttgatatcaagatatggtggcctcatagtatgagttgtaaagtttactctccttttctgtctcttggaagagtttaagaaggattaatgttaatccttccttaaacatttagtagaatttaccagtgaggccttctagcacaatgcctggcacataatatatggaatctaggatttgtatagtcagtcattaactatttgttgaattaataaattgtctccccaagcaggtttctaatcaaggcacaaagattgagtaacgaatgaaggcaaagccaatgtatacagggtattagttttctaatgctggggtggcaaattaccacaaacttaatatggcttaaaacaacacaagtttattatcttacagttcgatagggcagaagactgacccaagtcttactgggctaaaatcaaggtgtcatcagggctgcatttctttctggaagctctagaaaaggatcctttttcggtcgcctgtagtcccagctactcgggaggctgaggcaggagaatggcgtgaacccgggaggcggagcttgcagtgagcggagatggcgccactgcactccagcctgggcgacagagtgagactccctctcaaaaaaaaagaaaaagaaaaggatcctttttcctttcttttccagcttctagaggccacacacattcattaactcatggcttccttcctccatcttcgaagccagtaacattgcacctttgtgactattcttaagtagtcacgtctccctttgactctcctcttctgcctctctctctcactttcaaggcctcttgtgattacattgggccgacctggataatccaggatattctccctattttgacatcagctaattggcaaacttaattccatctgcaaccttaaatccctcttgccatgcaacataacacagtcaaatgttctggggattaaaatgtggacatcactgagagatcatattcttcctagcacatacggtttagtcacaagttaatgatcaacatttattagctatataatactcttaagttcaacataaactttttggatgctgataaaacggaatggcattttacattgatatatacttcatttcaaaacttcttctacttctcaatgattattctgtagcaacaaatttcttttaaatcagaaatttggaaacataacgagacctatctcaaatcaaagatgactatccccttttggagtcagactacacattcattattttagtcaaaatgagacataaaattcaggcccccaagagctgccagtacccacttacgcaggaggtagctagacgaaacaggtagctttctacaaatgattttgcaccatcccaccccagagaggtggtttggagtgtttacttattacctgggatttaattatactagctcttgcaaaagccaaatctaaaggccataaatagaaggtcaaattttctcctatatagaaaggagagcagcagagaaaacaaaatccttggtaaatctttaaacaaagttatatggtttgaatatgttattcattctattttaaccccccaatacagatatatttataaaaaagaatattgtgatttctggtataacttgtttaggaacaaagccacaaatttattaatattttctattccctgggaagaaaaaaatgctacatggcagaataattttttaaaatttccagccgggcacggtggcttatgcctgtaatcccagcactttgggaggccgaggtgggcggatcacaaggtcaggagattgagaccatcctggctaacacggtgaaacaccgtctctactaaaaatacaaaacattagctgggtgtggtggtgggcgcctgtagtcccagctactcgggaggctgaggcaagagaatggcgtgaacccgggaggcggagcttgcagtgagccgagatcgcgccacggcactccagcctgggcgacagagcgagactccgtctcaaaaaaaaaaaaaaaaaaaaaattcccatgatactaaactgatgtgtgatcatataatagacttacactgatacctattttagtgtattcaagcagataaaaaatcccaggtgttctatgagtgatatcattttcagtatttcttatgctgtatgccatggtttaaatctaggcctttcgaattggcattactaccatatttctcaaactgtattccctttctcttgaatatgttatgtaattttgtccagaacccagacatgtcaaggtgtcaaatcccacgttttggatactaacgtgtctcattaattcatacagtgggatcattcattaatgcccacattatagactctctctctctctacacacacacacacacacacacacacacacacacacactacattcttagaagatcattctgagaccagggtggaggataggctgtgcattcccagtactctttcacagctgactgtgtcctctgccagtgttttcaaactttactgcttatgaaacagctaagggtcttattaaaatttagattctgattcagtagaactgacatggtgcccaaggaactgcatctcttttaaaaaatctttatttaggtataattgacaaaagttgcatatatttaagaggtacaacttgatgttttgatatattttgtttttcatatatgatgtttgatacattgtgaaatggtcaccacaagcaagctaattaagatatatctatctctttgcctagctacctttttttgtggtgagaacatttatgacctactcttttagcaaatttcaagtatacaatattgtttactatagttactatatcgtacattagatctccagaactaatttatcttgcataattgaaattttgtaccctttgatcaacatctccctgtttcccccacaccacagtccctagcacctaagattctactgtctgcttttatgagtttgaccatcttagattccacatatgaggtcatgaagtatttttctttcagtgtctggcttattacacttagcataatattttccaggttcatccatgttatcacaagtgggaggattttcttctattttaaggccaaataatattttataattgtgggaatattccatcagatatatatatatcagattgtctttatccctccatccatcaatggacacacttaggttgtttccatatcttgactattgtgaatactgttacagtgaacatgggagtgcagatattcaacatactgattttgtatcctttggatatataacagaagtgagattgccagatcacatggtattcatttttagtttttttgaggaacctctatgctgtttttcataatggctgtaccaatttatttttgcagcaacagtgtacaaaggtttccttttctccacattaccaccaacatttgtcatcttttgtctttttgataatagctatttgctatggtttgagtgttttccccaaaaaacatgtgttggaaacttaattcccaatgcgacagtgttgggaggtagggccgaatgggagatgtttaggttatgaggactccaccctcatgaatggattaatgccgattacaaaagcacctaaggctgtgaatttgaattgctctctcttgccctctttttgcccttctgccatgttatgatatagaaagaaggcctttgccagatgctggcctcttgatcttggactgcccagcctccagaactgtgagccaaatacatttctgttcactacaaattactcagtctgtggtattctgtcatagcagcataataaattagagtccataataagttatagtccataacagactaagacactattctaatagatgtgagggaatatctcattgtgttttgatttgcatttccctgtgggttagtgatgctgagcatcatttatctgttggccttttatatttcttcttttgaaaaattctatttgggttctttgcccatttttaattgggttgtttcttactaatgagttgtttgagtttcttacccattatcagatatacagtttgcaaatattttcatccattccataggttgtcttttcactctgttgattatttcttttgctgtgcagaaagtttttagtttaatgcaatcccagtttctatttttgtttttgttgcctgtgcttttggtgtcatataaaaaaattattgcccaaatcaatatcaggtagcttttttcctgttttcttctaggagttttatagtttcaggtcttatatacaagtgtttaatcaattttgagttgaattttatgtatagtgtgagaaaagggcccaatttctttcttctgcatgtggatattcagttttcccaatatcatttattgaagagactctcttttccccgttgtgtgttcttggcacccttgtcaaaaatctgttgactgtaaatgtgtgaacttatttctgggcttttctattctgttcccttggttgatgtgtctatttttatgccagtaccatactattttgattactggagacttgtagtatattttgaaatcaggaagtatgatgcctctagctttgttcttcttgcttaagattgctttgccaggctgcatgtggtggcccacgcctgtaatcccagcactttgggaggctgaggtgggtggatcacttgaggtcagaagtttaagagcagcctggccaacatggtgaaaccccgtctctactgaaaaaatacaaaaattagccaggtgtggtagcaggcccctgtgatcccagctaatctggaggctgaggtggagaatcacttaaacctgggaggcagaggttgtagtgagccaagatcgcaccactgcactccagcctgggcaacagagcaagactctgtctcaaaaaaaaaaaaaaaagattgctttgcctccttggggtcttttgtgatttcatattaattaaaattttttttttatttctgtgaagaacaccattgagattttgatagggatcacatcaaatctatagattactttgggtagtgtggacattttaacaatactaattcttccaatctaggaatatggaatatcttttatttatctgtgtcttctttaatttccttcataaatgttttctatattttcattgtacaagtctttcatttctttggttaagtctattcctaagtattttattcttttgttgctattgtaaataagattattttctaatttcctttgggatattttatagtgtatagaaacaccactgatttctgtatgttgattttgtatcctgcaactttacagaattcatgtattagttctaacaatttttttttgagtctttagagttttctacatgtatgatcatgtcatctgcaaaaagagataattttactattctcttctatttggatgctttttattttatttattttttaaattatattttaagttctgggttacatgagcagaacatgcagttttgttacataggtatacacgtgccctggtggtttgctgcacccatcaacccgtcacctacattaggtatttctcctaatgttatccctcccctagccccccaccccccaacaggccccagcgtgtgatgttccactccctgtttccatgtgttctcattgttcagctcccacttatgagtgagaacatgcagtgtttggttttctgatcttgtgatagtttttgagaatgatggtttccagcttcatccatgtccctgcaaaggacaggaactcatccttttttatggctgtatagtattccatggtgtatatgtgctacattttcttaatccagtctatcattgatggacatttgggttggttccaagtcttcgctattgtgaatagtgccacagtaaacatacatgtgcatgtgtctttattgtagaatgatttataatcctttgggtatatgcccagtagtgggatttgctgggtcaaatggtatttctagttctagatccttgaggaatcgccatactgtcttccacaatggttgaattaatttacactcccatcaacagtgtaaaagcgttcctatttttccacaacctctccagcatctgttgtttcctgactttttaatgatcaccgttctaactggcgtgagttggtatctcattgtggttttgatttgcatttctttaatgaccagtgatgatcagcattttttcaaatgtctgttggctgcataaatgtcttcttttgagaagtgtctgttcatatcctttgcccattttttgatggggttgtttgtttttttcttgtaaatttgtttaagttctttgtagattctggatattagccctttctcagatggatagattgcaaaaattttctcccatcctgtaggttgcctgctcaccctgatgatagtttcttttgctgtgcagaagctctttagtttaattagatctcctttgtcaattttggcttttgttgccattgcttttggtgttttagacatgaagtctttgcccatgcctatctcctgaatggtattgcccaggttttcttctaggatttttatggtcctaggtcttacgtttaagtatttgatccatcttgagttgatttttgtaaaaggtgtaaggaagggatccagtttcagttttctgcatatggctagccagttttcccaacaccatttattaaatagggaatcttttccccattgcttgtttgtgtcaggtttgtcaaagatcatatggttgtaactgtgtggtgttatttctgaggcctccattctgttccattggtctgcatatctgtttggccccagtaccatgctgttttggttactgtagccttgtagtatagtttcaagtcaggtagcatgatgcctccagctttgtccttcttgtccaggattgtcttggctatgagggctctttgttggttccatatgaagtttaaagtagtgttttccaattctgtgaagaaagtcagtggtagcttgatggagatggcattgaatctataaattactttgggcagtatggccattttcatgataatgattcttcctatccatgagcatggaatgtttttccatttgtttgtgtcctctcttatttccttgatcagtggtttatagttttccttgaagaggtccttcacatctcttataagttgtattcgtaggtattttattttcttagtagcaattgtgaatgggagttcactcatgatttggctctctgtttgtctgttattggtgtataggaatgcttgtgatttttgtacattgattttgtaccctgagactttactgaagttgcttatcagcttaaggaggttttgggctgagatgatggggttttctaaatatacaatcatgtcatctgcaaagagagacaatttgacttcctcttttcctatttgaataccctttattgctttctcttgcctgattgccctggccagaacttccaatactatgttgaataggagtggtgagagagggcatccctgtcttgtgccagttttcaaagggaatgcttccagtttttgcccattcagtatgatattggctgtgcgtttgtcataaatagctcttattattttgagatatgttccaccgatacatagtttattgagagtttttagcatgaaggggtgttgaattttatcgaaggccttttctgcatctattgagataatcatgtggtttttgtcattggttctgtttatgtgatggattatgtttattgatttgcatatgttgaaccagccttgcatcccagggatgaagccaacttgattgtggtagataagctttttgatgtgctgctggatttggtttgccagtgttttattgaggatttttgtatcgatgttcatcagggatattggcctgaaattttctttttttgttgtgtctctgtcaggttttggtatcaggatgatgctggcttcataaaatgagttagggaggattccctctttttctattgtttggaatagtttcagaaggaatggtaccagctcctctttgtgcctctggtagaatttgtctgtgaatccgtctggtcctgtactttttttggttggtaggctattaattactgcctcaatttcagaacttgttataggtctattcagggattcaacttcttcctggcttagacttgggagggtgtatgtgtccaggaatttatctatttcttctagattttctagtttatctgcatagacgtgtttatagtattctctgatggtagtttgtatttctgtgggatcagtggtgatatccccaatatcattttttattgcatctatttgattcttctctcttttcctctttattagtgtggctagaagtctatctattttgttgattttttcaaaaaaaccagctcctggattcaatgattttttgaaggtttttttgtgtctctatctccttcagttctgctctgatcttagttatttcctgtcttctgctagcttttgaatttgtttgctgttgcttctctaattctttaattttgatgttagggtgtcaattttcaatttttcttgctttctcttgtgggcatttagtgctgtaaatttccctctaaacactgctttaagtgtgtcccagaaattctggtacgctgtgtcttcattctcattggtttcaaagaacatctttatatctgccttcatttcattatttacccagtagtcattcaggagcaggttgttcagtttccatgtatttttgtggttttgagtgtgtttcttaatcctgagttctaatttgattgcactgtggtctgagagactgtttgttatgatttccattcttttgtatttgctgaggagtgttttacttcgaattatgtaatcagttttagaataagtgtaatgtggtgctgagaagaatgtataatctgttgatttggggtggagagttctgtagatctctattaggtctgcttggtccagagctgagttcaagtcctgaatatccttgttaattttctgtctcattaatctaatattgacagtggggtgttaaagtatcccactattattgtgtgggagtctacgtctctttgtatgtctctaagaacttgctttatgaatctgggtgctcctgtattgggtgcatatgtatttaggatagttagctcttcttgctgcatttttccctttaccattatgtgatgctcttctttgtctcttttggtctttgttggtttaaagtctgttttatcagagattaggattgcaactcttgcttttttttttgctttccatttgcttggtaaatattcctccatccctttattttgagcctatgtgtgtctttgcaagtgagatgagtctcctgaatacagcatactgatgggtcttgactctttatccaatttgccagtctgtgtcttttaattggggtatttagcccatttacatttaaggttaatattgttatgtgtgaatttgatcctgtcattatgatgctagctggttgttttgcccattagttaatgcagtttcttcatagtgtcaatgttctttacaatttggtatgtttttgcagtggctagtaccagttgttcctttccatgtttagtgcttctttcaggagctcttgtaaggcaggtctgatggtgacaaaatccctcagcattcggttgtctgtaaagaatttcatttctccttcacttatgaagctttaagaggtttaattgactcacagttctgcatggctgtcccataagtcccatgttctttcctcaggaaacctacagtcatagcagaaagggaaataggcacatcttacatggcagcaggcaagagagagtgtgtgaaggaggaactgtcaaacacttataaaaccatcagctctcataagaactcactatcaggagaacagcgtgggggaaaccatccccatgatccaatcacctcccactaggtccctcccttgacatgtgggcattatggggattacgattcaaggtgagatttgagtgggaacatagagccaaaccatatcagtatctaaaaggaaaaaccttcagtttttccacatttggttatgatatcagctgtgagcttttcctatatggtctttattgtgttaagttccttctgtatctatcttgctgaaagtttttattatgaatggatatctagttttgtcaaattctttttctgtattgatcgaaataatcatgtgtttttcatctttcattctgataatgtggtatatcacattgattgatttgcccatgttgaaccatccttgcatcctagggataaataccacttgttcatgatgaatgatccttttaatgtgctgttgaatttggttggctggtgttttgttgaggatttttgtatccgtgttcatcagggatattggcctgtagttttctttcttttcttttcattttctttttctttctttttttttttttttttttttgagacagagtcttgctctgtcacccaggctggagtgcagtggtggtatgatcttggctcactacaacctccacctcctggattcaagcgattctcctgcctcagcctcctgagtagctgggactactggaacatgccatcacacccagctaatttttgtatttttttagtagagatgagttttcaccttgttggccaggctggtctcgaattcctgacctcaagtgatttgcctgcttcagcctcccaaagtgttgggattacaggcttgagccaccacacctggcctggcctgtagttttcttttctagtgttgtttttgcctggatatggtatcagggtgatgttggctaataaattgtattttgaagtgttctctcttgtattttttggaagagtttaagaaatactggtattaatacttcgttgaatgtttgatggaattcatccatgaagccattggtcctgggcttttctttgttggaaggtttttgattactagatttaatatccctatttgttgttagtctgttaaggctttctatttctttgttattcagttttggtatgttatatgtttctaggaatttatccatttcctctaggttaaccaatttgttgacacttataatagtcccttatggttctgtctgtttctgtgacatcagttgtagtgtctcctctttcatttatattttatttatatgagtcttctctctttttttcgtagtctagataaggacttgtcaattttgtttattttttcaaaaaaatcaactcttagttttgtcagttatttccaattgtttttttattctcttttttatttatttctgctctagcatttattatctcctttgttctgctacctttgggcttagttttttttttcttctttttgtagttcctggaggtgataagttgggttgtttatttcatatgtttcttctttttaaatataggcatttattgctataaatttccctattagtatgcttttactgcatcctttaagttttggtatattatcaagattttggtttcttctgtgacccaatggtcgttcaagaatgtgttgtttagtttccacatatttgtgaattttcgtgttttcttattgttattgatttgtagtttcaatccattgtggtcagaaaatatacttggtatgatattaatcttcttaaatttattatgacttgttttgtgacctgaaaggtgatctgtcctgaagaatgttttgtgtgtgcttgataattctactgttgggtggaaagttctgtatatacattttaggtccattgggtctattttattcttcagttctgttttgtccttattgattttctgttgggatgatctattcattatagagagtggagtattgaagtcaactatattatattgttatctatttctccttccatgtctgtcaatgtttgctttatatatttaggtactttcgtgttgggtacatatatatttataattattacatcttcctgttcaagtgacccttttattatataatgaccttctatgtctcatgtcacagttttttacttaaagactattttttctcatacaagtatagccacccctgctctcttttggttacagtttgcatggcataactttctccaccccttcactttcagcctatgtatgtccttaaatcaaaagtgagtctgttatcaacaacatgtagttgggtcctgtttatttttgtttcttacttcccatctctgaattgttggctttttaaaaagcccattcagttactctgtgtcttttgactggggagtttagtcaatttacacttaaagtaattattgataggttaggactttctgttgccattctgttaatagttttctgttttgtagttttcttgttcctttcctctttttctttctttgtggtttgatgatttttgcttggatgtgttttgattcttttctctttatcttctgtatatctactgtgtgggggggcggtcgggggggttaccacagggatcaaattgaacactttatagttatggcagtctgttttaagctgacaacaccttcaatcacatacagaaactctatactttactcattccccccgccacaactttatgtaatcgacgtcatattttacttccttctatattgtgtttccattgacaaatttctgtcactatagttactattactatttttgtcttttaatttataaattaatattaatagtgatttataacaatcattatagtgttacaatagtctatgtttctctttatatttacctttagcagtgaaaggattcatatgcttttgtgttactgttttttttttatttcaacttgaagaactattagcacttcttataaggcaggtctcatggtgacaaaccccctcagtttttgtttgagaaaggctttatctttgtgttcattcttaaaggacagtttttccagataaagtattgttgattggatttttttctctcagtactttgaatatatcatcccactctttcctgacctgcaaggtttctgctgagatatccactcatagtcttatggagctcccctataggtgacaattcactttcttcttactaccccaaaattctcttttgtctttgttgaaaatttaattataatgcatctcactgtagacttctgtgggtttaatgtatttggttatctttgggcttaatgaatccagatggcacttcccctccatagatttggggagttctcacctattatttctttaaataagtttcctttctctctctcttctccttttaagatttctataatgcatctatcattttgcttgatgatgtcccataagtcctctgttcttccttcactctttctcattgttctttttattccgctaactagataatttcaaatgacttgtcttcaagtttacaaattctttcttctgaatgattgagtctgctattaaagatcgctattaaattttttagttcagtcattcttcagctatattcagcaatattctttagctacaggatttttatttggttcttttttatggtttttatttctttattaaacttctaatgttgttcatgtattgttttcctcattttgttagtcgtcttcctgtatcctcttgtagctaattgagcttctttaaatgattattttgaattctttgtcaaaaatttcatgaatctccatttcttcagggttggttactggagctttattagttccctttggtgatgtcatatttgcctgattcttcatgatccacatagcctagcattggtatctgtgcattggagtgagctgacacctcttctggtctgaagttgggtactcagacaatgggcccattaccagggctttggataggtgtagctctcactgggtccttgagtgggcaggactgcctgcagaccatgatgcagtgggcctggagctgggtcaaagggctgcttcagggtccccacttgggcccacagtcagtgggcctgttatgggggcacaggtaagtgtggattcaggcaggactgtctccagaacatggtacagcaagactggagttggctcacagggttacttctgagtccacagtcaggtctagttggtgggcctgcttccagaggtggactggcatgactcccacctgtttcctaagtaggcaaaacttccccaagaccatggtagtgtggtactgaagctgctttaggtacagggctgcttcagagtccacagttgggagccctgttactggggttgccaatgggagttgctcctcccagattcctgggcagatagggatagtggtaggaccacatacaaacaactctggagctaagtccccagggtggtgggctgcttctgggtccacaaccagaactacagttgacaggcctgccgctagaatgtgggcctgccttattaaagtattcatctttgttcttgagctctaccagggtttctcaacctcctacctgaatcccaaggctcccacaaagacacttttgtccatagatcattgtcaaattattgttcctgtgggggaacaagagctagggacctcctatcccatcaactcactgataccgttctcctgatgctgcattttgaattgccctcaggtgatgctgctactcctggtctgtggaccatgctggagtagcagagcccaaatggcttcctcaacttttatgagccttttacaggaactcaaagtagaaaataacttcacttgccccagacctaataatttcctttgttcccacttcttcttggtgctttcctcctttgtgtctaccatcgtaacatccatctaaccatagttgtcttatgtagatgttggatgctgttgagaaacgcacaaagcaaattagaaggaagatatgattgacagaaattgctttttactctgtattcactttccatgtatttgtgctaatctctccatacaggtcttctttggcaatgtggattcatctgggataaaacacaatatttttaaccctccaattattgctcgatacatccgtttgcacccaactcattatagcattcgcagcactcttcgcatggagttgatgggctgtgatttaaatagtaagtgccaagtcatcccatatccttcttccctcaaccatgggtagggtgactaactgttctagttatcctgagactgggggaggggttcccggtatcaggacacaaaattgtcagtgctaaaaccagcatagtcctgggcaaacccagaaataccattcaacccagcagtcccatcactgggtatataatcaaaggaatataaatcattctgtcataaagacacatgcacgcatatgttcatttcagcactattcacaatagcaaaggcatggagtcaacctaaatgcccatcaacaacagattggataaagaaaatgtggtacatacataccatggaatactatgcagccataaaaaagaatgagatcatgtccttttcagcaacatagatgcagctagaggccattatcataaatgaactaatgcaggaacagaaaaccaaatatcatgtgttctcataagtgggagctaaacattaaatgcacatggacacaatgatggacactcaggaggggagaggttgggaggggggtgtgggttagaaggttatgtattgtgtactgcactcactacctgagtgaggggatcattcatacaccaagcctcagtgacatgcaatttacccatgcaacaaacctacccatgtacccctagaatctaaaataaaagtagaagaagaaaagaaacaaagaaaattaaagagtcacacaaagtgggaagagctggctggaaaacagatagcaataacagaattggccgggcgtggtggctcacacctgtaatcccagcactttgtgaggccaaggcgggtggatcacgaggtcaggagatcaagaccatcctggctaacatagtgaaaccccaactctactaaaaatacaaaaaattagccgggtgtggtggtgtgcgcctgtagtcccagctactcgggaggctgaggcaagagaatcgcttgaactcgggaggcagaggttgcagtgagctgagatcatgccactacactccagcctgggtgacaaagcgagactccatctcaaaaaaacaaaaacaaaacaaaacaaaacaaaaaaccaataacagaatctgtgcaaaagttaaaacctgagaaatgatattatgatgacagtagccctagaatatcagtggaagctgctcagtataactgaggctgaagcatgtccttgtgataaccttcttttttcttttctttgaggttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtaagaggcaacagatttactgtttaactgactcagagcagtggttggggaaaaaatcggggaaggccttgactgtttcttctgaggtatttctgtcaactgttagttctaaaaagtgtgtcaaggaagtttggttatgggcagacaaccacacaggcatttgggggaaatgatctctaattgaacctcctggaagaagaatctctatatctagtactgagctaatatctgtcaaagaattgtagaagctaaagtccattttacagataaatatcaacaattagctttctttccaggtttctcattacatcaatgaaaagtaaacatttactgcacatcttagtatccctaggatgagcctagggatacaaaggtgaattgtgaaaaattttggccctgaagttgcttagagttgaataagagagactgactagccaatagaaagtggaggctgggtgcggtggctcatgcctgtaatcccagcactttgggaggctgaggcgggccgatcacaaggtcaggagttctagatcactcttttgctgaggcaggataatcgcatgaacctgggaggcggaggttgcagtgagctgagatcatgctattgcactccagcccaggcaacagtgcctgactctgtctgaaagaggcagagagagagagagagagaaagaaaggaaagaaggaaggaagaaaaagaaagaaaggaaggaaggaaggaggccgggcagagtggctcacgcctgtaatcctagcactttgggaggcctaggtggcagatcacctgaagtcaggagttcaagaccagcctggccaacctggtgaaacctcatctctactaaaaatataaaattatctggacatggtggtgggcacctgtaaccacagctactcgggaagctgaggcaggagaatcggttgaactcgggaggcagaggttcagtgagctgagatcatgccattgcactacagcctgggtgacagagcaagactccgtctcaaaaaagaaagtagagtgagaagtgctgtggtatggttaagagggatttgggaatttctgggagtaaatggtgaccaagaggctactagtccaactctattgccctcaggtgaataatccaaaagagtggctgcaagtggacttccagaagacagtgaaagtcacaggagtaactactcagggagtaaaatctctgcttaccagcatgtatgtgaaggagttcctcatctccagcagtcaagatggccatcagtggactctcttttttcagaatggcaaagtaaaggtaagctggtctccttggaaagaaagaaagaaagaaaaaaaataccacctctcctagagcttaacataacataaaaaggttgatatatgaccaaattttcagagcaaaatttattaagtacctatggtagcaagacattgtaaaaggcattctgagagaacacagtgactttaagaaaaaggtaaaatactgagaaaagggcagagtagatccaagagttaattctcctcatcagcaccttgattcccaagcctttttgacctttaagtttagtggtccaggaagtcttcattcttaatctgggtttgctggataattcaacaaattgtcctgattaaaagacatgacataaagtcttatcaccccatgagtaatgggggaaggaatagttcctctctttggtattttttatattcttttttcaccaagaattaaccatgatgtggtccttaccaatctctctaatacagtctcttgccacttggctctttaagctccatccatactaagaaattctcaggtcactaaatacagccattatatctcataccaggcttttaaatagatactatttcttctacctggaacatttttctagctaccctctactgccactttcacctgactcattcgttaagtctcaggtaaacatcatgtccaagaagaattcccttatccatcaaggctggatgaaagacttcaccaaactggcagtttggtgaactgaagtctagacattggatattctagaagaaaaattcccatttaaaaaaggttatatctctgattagtgccacaacatgatgaactttcaaaatatgctaagtgaaggccgggcgcggtggctgatgcctgtaatcccagcactttgggaggctgaggcaggcagatcacgaggtcggtaaattgagaccatcctggctaacacagtgaaaccccatctctactaaaaatacaaaaaattagccaagcgtggtggcgggtgcctgtagtcccagctactcgggaggctgagacaggagaatggcatgaacccgggaggcagagcttgcagtgagccgagatcgcaccactgcattccaacctgggcaacagagtgagactccatctcaaaaaaaaaaaaaaaagaaaatacgctaagtgaataggccagacataaaaggatagatattatatgattctacttatatgagtgtgttagtcagggatatccaaagaaatagaaccaataggagattctgtctgtctgtctctctctctctgtctctctggatgagctaaactgttttagttcaagactgaaagcaggaaaaagctgatgttccagtccaaaggcagacaggcagcaagaatactttcttacttggggaagactcagtctttttgttctattcaggccttcaactaattggatgatgcctcccacattagggagagcaatctgctttactcagtctactgacttcgatgttaatcccattcaaaaacaccttcacagaaataaccagaataatgtttgagtaaatatctgggcaccttatgaccaagtaaagtagatacataaaattaaccatgacaagtccaccccttgtcaatgtagcacccatcatacacatctcctttatctctaagtagagacaaaaatgaggtcataattccacctaacatgatataacaaaacttggctggtattgataactaccttcttctactacccattctgtattgactttgccttcagcaagcatctcagctgattgtggttctttacctgatgaggtgacccaaacctttattcctgaagagcctgggccactagtagtcctgcatggattgggttgctgtagtttcccattgaccagaatcatagggcctggtaatactaagagacactctaagggatctattgtattccagacacactcttccatacctccattgtgaagcagtagttcagtttccttccaggaaggacaaaacgctgccccttccatgatgaacatattccaatgtaatcaacctgctgccagatagctggctgatcatcctgggaaatactgccatactgaggactctgtgtttgtctctactgctggcagattgggcacttagcagtggccatagccaggtcagccttgttgaatagaagtccatgttgctgagcccatgcatagcctctatccctgccaccatggctactttgttcatgagcccatcaggcagtgacataggtggctgagtaaaaaggatgactggtatccacagaacaggtcatcatatctactttttttttgagatggagtcttgctctgttgcccaggctggagtgcagtggcacaatctcagctcactgcaacctctgcctcccaggttcaagcatttctcgtgcctcagcctcccgagtagctgggactacaggcacgcatcaccatgcctggctaatttttgtatttttagtagagacagggtttcaccatgttggccaggctggtcttgaactcctgacttcaggtgatcctcccgccttggcttcccaaagtgctgggattacaggcgtgagccactgcacccggcccatcatatttacttgattattgaaatccttatctgctgaggtcacccttcgttgagcactcacatgggacataaatatattcacatcctttgcccattcagagagatctgtccacatacctcttccccaaatttctttgtcacctgttttctaatcatgttccttccaagtccctatctggacaaagcactgactacagcccattacttgacatataattgcacacctggccatttctccttctaagcaaagtccacaaccaggtacactgcctaaaattctgcccactgtccttcatgggtatctcagatcgggactgtccacttttgtgtagtacctgcatatcgtgcagaaccgtctgtaaaccaggcccaagactcctcttcctctgtaaactgatcatagggaactcccaatggggccataagtgcaggctgggagagagaaggcagggtagcagaaacaggcaccatggacatttgggctacttcttcatgtaatttacatgtgttttcagtacctgctcagacatgatcatgtatataccacttccatttgatgatggagtgccattgttcatacccaactttatggcttggtgggtcagataacacctagttcatgatgggcagttcaggtcacatggcaacttggtggtctgtggctaagcattcagtatctactaaggcccagtagtaggccaagagctatctcacaaaaggagaacagttattcacagaggattacaggaggatttctcactacagtagcccctgctccataggtcagggaaccaatgtgaagatcctgctagctgctcaatatatctgttccaattacgcattccaggactggggaaataaccacaagatagtctcacagatcctctgcatccactttgagatggacttgagctaaaattccattgatcatttgaccctccataagcccatactctgactggtggaccacagtgacattttgggtctcctgaaattagtgccagttcagagccattgtccagtagtccctgaaaggtctgattaattatttttcttcagtgcacatttattctgatagaaaggccatatgtccctttggggaaggctgagagaaagagtggcagtattcttggcagtgtaccagagtccttcctcaaggagactgagcctccccttcattcaaggagtgctgggtctgtaaacctgctcaagtctgggaattgattgagaggccgtgactctgtttttattattcaggttagacttttgttcacttgacctagaacttttccacttatgcagttcaagaatttggtaggcattctatctatatcacatctaggaacactataatctactagccaacaccataggtctgtgcaagtcatactattctaactgctgctttgactctgctgtcccttatggtaaccacacttaccttgcctttggcagttgagtgctgcccattggccccttccaccccaggatccaattattcccattgtatttaggttttctaattcagtgactgcaggtcctgctgtaaggtgtcacctacagagaagagtgatcacagagcccttcaaggatgctgaggttcccctcacaaatttattcctcaaagtaatagtgagatctgtgtcttctgaactctcccagtgttggtgagtatgtcttaaatgacaaattcactctagcatttcaatctcctttcttctacattaaaccagggcaagtctgaaatttctagtttgctcactgtgggccatcttttggtctgtgtttcagccaaccaattaaactgttagaggccttcctaattccctgagatgcaacattaagtccagaatctctgcttagtgggcccatgtcaataaatttggcctaatccaactttacgtgccttccaccgttatctcacatccttagtacccattcctatacatattctctggattcctgcttgtgtaaattagaaaactcaagtcatgattttggagtgtagtgcaccttgtcatgggtcaccttcatacctcacctcgcctgctgggacttgagtgtagttatagatctaataacaaagaggggtggtagggtgggtcctgaaggaatcagcattatcttgcatggcagttgcctcaggggaagccattacagtttcctcaggcagtgcagggttaatccacttagactggagtagagatactgccaccacagggctggagagaaaactttcactgacaaagaagactcatcaatatttaggagctcaatgtccccagcttaatcagggtcttccacacatacctaatccaacttgtagtgccccattctttcccaatcactgcccttgctttaacagtagacaccctgcaaagctgggagtttggcttgctttgtaattcagttagtcacaggatgagatttggcatttgattttcagcaatctcagctctgtggctacagtagataagggtctccttcagggcatacatagaatctgtcaagtcatttatgcagctcttgagctgggaattcaaattcctgagctcctccttttctttcatcactttttccagcaacattaggagcaaccgactaatcccatcatattcattagtttgacaaatatgttcacaagtgtcaatatacatagtcaccaagacccttgcttcttaaaagtagttgattaggagtatccaatggagatattttgcatatacatattttttgagatggagtctcgctctgtcacccaggccggagtgcagtggcatgatctcagctcactgcaacctccatctcccaggttcaagcgattatcatgcctcagcctcccgagtagttgggattacaggcacctgcctaatttttgtgtttttagtagagacagggtttcatcatgttggccaggctggtctcgaactcctgacctcaggtgatccatccacctcggcctcccaaagtgctgggattacaggcgtgagccaccgcgcccagcctggcctacatatttctattgccagatcatgccatggacaatttttactactgaaaatagtcattagtgtctttaaatttcatcaggttacagaaccaattccagaaatccaataacaaatttataaaatttatccttaaaattctgttcctttagaatcactcttggtgtgaaaatctgtattagtcatggttcccaaagaaacaaaaccagaaccaagaggagatacatacacacacacacacacacacacacacacaaggaattagctcatgtgattatggagtctgccaagtctcaagatctgcagggtgagttggcagcctagagaccccagagagctgattcgtagttccagttcaaagaccagcaggctacagacccagaaagagttaaaatgttttagttcgagcccaaaggcaggaaaaaaactgaagtcccagtttaaaggtagtcaaatagaaggaactgtctcttactaagaggacagtaagcctttttgttatatttaggccttcaactgattggataagttctacccacactggggagaacaatctgctttacttagtctaccaattcaaatgttaatctcaccaaaaaacactctcacagacacacataaaataaagtttaatcaaatatatgggcaccccatggcccagtcaagttgacacataaaattaaccaccataatgaggtatctagagcaggcaaattcataaagacagaaagtagaaaagaggttaccagggtcttggaatggggaagaaatggagagttatttttaatgagtacagagtttctgtttggggtgatgaaaaagttctggaaatggatagtggtaatgggtgcacaatattgtgagtatacttaataccactaaattgtacacttaaaaatgattaaaatggtaaattttatgtatattgtacaacaataaaaaaggctatatcactgacaatgcattgttgtatttagcaaagaaaggggaatctccagcctccccatcaacaaaaacccccacaaacttctattttaaaataatgagctgaaatcatagcggagaggtgaataatgagcaaatataaaaaggaagacctttcctcagacagaatgcccatattaatgttgttactggaagactaagccttgagcaaaatgcaaggagaactcagtgtgagaattctgcattgtcatgaatcccagaaggaagctagagaagttgcagataaatattatcctctggcacctggaagaaccattctcaacctactctagaaaaaaagcacctccagtttaggcctccaggattcctacatattaaaattataagatcacagacatagatcagcaaacatgcaagacaacaagacaacttgagtacaagtgaacagaaacaatcaattcagatttaaaacttgaagaacaccagatattgacattatcggatacataatatgaaataattatgtataaaatctttaaagtaataacatatggaaacatgaaaataaaagacaaattatccaacattattaggcagttgaaaaaaaccattgcaggttacaaagtcaacatgcaaaaatcaattgtatttttatatactaacaattacaaatatgaaaaggaaaacagaaaagtctatttacaatagcatcaaagataatacaatatttaggaataaatttaacgaaggaggtgcaagtcttgtccactaaaaacaaaaaaacccagttgaaagaaactaaagaactgtctggtctgaagacagcaaatatggaaaattagcaactagaaaaaaattaaaaattaaaaattaaaagagaaattaaataactaaataaatgaaaaggcatcctggatttatggatttgaagacataatattcttaagataagaatattaccacaaaccatttgcagattcaaagcaagcattctgggtttttttgtttgtttgtttgttttttgatttgagacggagtctcactctgtcgctcaggctgcagtgtggtggtgcaatctccactcaccataacctctgcttcctgggctcaagcgattctccggcctcaaagcattctctatcagaatcccaaagacatttttttttttgaggaatagaaaaatctatcctaaaattcagatggaatttcaagggaccctgaatagccaaaacaatcttgaaaaagaacaacgttggaggagtcatacttcccaatttcagaacttactacaaagctacaagaatcaaaacagggcagtacttacataaatatagacacatagatcaatggaatagaattgagagtccagaaataagcctatacatctatggtcaattgattttcaataaaagtgccaagaccattttgtgggaaaagaatagtctcttcaacaaatggtgctgggacaattggatatccacatgcaaaagaatgaagttggatctttaccatatacaaaatttaactcaaggctggatgtggtggctcacatctgtaatcccagcactttgggaggctaaggctggtggatcacttgagctcaggagtttgagaccagcctgggcaacacagtgagactctgtatctacaaaacaagaaaaaaaaattagctggcatgatggtacacacctgtagtcccagctactagggaagctgggataggaggatcgcttgagcccaggaggtggaggctgcagtgagccatgatcgcaccactgcactccagcctgggtgtcagagcaagaccctgtctgtaaaaaatcatttaactaaaaatgtatcaaaaaactaaatataaaagctaaaaccataaaactgtaagaaaaaacaaagaggtaaattgttatgatactggatttggcaatggtttcttagatgtgacaccacaatcacaagcaacaactctataaaaatatatatagtaggcatctttaaagttaaaagcttttgtacatcaaagaacactatcaagaaagtaaaaagatgatctacagtataggagaaaaaaattgcaaatcatatatctgataaagggcctagtatcccagaatataaaaagaactcttacaactcaacaacagaaagacaaccaaattttaaaatgggtaaaggacttcaatggaacttctccaaagaagatatacaaggatccaacaaactcatgaaaagatagacaacatcattagttattagggaaatgcaaatcaaaaccacaatgagatagcatttcaaacctgctaggatggctaaattaaaaaaaaaacaaaaacaaaatgtcaagcgggaaaataacaagtgttagcaagaatataaagaaattggaaccttccttgatgatgagaatgtgaaatagggcagccactgtagaaaatattttggcagttcctcagtaaggaaaacatagaattaacatagacccagcaattctactcctgggtgtggacccaaaagaattaaaagcaggcactctaacaaaaactaatatacaaatgcatatagaagtactattcataatagcaaacaggtgaaaacaattcaaatgttcatcaagtgatgaacagataaacaaaatgtggtctatccatatatggactattatttattcataaaaaatcaaagtactgatccatgctaaaacatggatgctccttgaaagcattatgctaagtgaaagcagccaggcacaaaaggccacattccacttatatgaaatacccagaatagcaaatccatagagacagaaaacagattagtggttgccagaagctggcagaaggagtgaatgtggagtggcttcttaataagtattgaatctccttttggggttatagaaatgttctggaactagatagtggtgatggctatataacattgtgaatgtactaaatggcactgaacttcacactttaaaattgttaaaatggtaaattttatgtttgcgaattttgcaatagataagtcagaagacatgtacattaccataatgagtaacaaactgacagctgatttctaaataatagcaaatatcagaaaataatgaatgatgtcttcacaatgctaaaataaacaatgtgaacccctctctcaaaaagaaaacctaatgaaaatatcttttatgcgttaaagcaaaagaggaaattaggacacagacaggcacagagggacgaccacatgaagatatagaaagaggacagacacctacaagccaacgagagaggccttacaagaaaccaacccttagccaggtgtggtagtgtgcacttgtagttcttgttacaagggtgcagtgagctagggttgtgccactgcactccagcctgggaaacagaacaagaccctgcctctaaaaaaaaaaataaagagaaggagaagaagaagaaaaggaaaagaaaaaaaaaaagaaccaagcctgctggccaggcgtggtaactcatgcctgtaatcccagcactttggaaggctgaggcaggaagatcatctgaggtcaggagttcaagaccagcctgcccaacatggtgaaacccccctctactaaaaatacaaaaattagctggacatgctggcatgcgcttgtaatcccagctactcgggaggctgaggcacaagaattgcttgagcccaggaggcagaagttgcagtgagcccagatcgcgccatcacattccagcctggactacagagggagactccatctcaaaaaacaaacagacaaaaaaaaaatacacacacacacacacacacacacacacacacacacaaaacaagcctgcctaccccttgatcttggacttgtagcctccagaactgtgagaaaataaatttctattgtttaagccaggtgtgcgtgtgaaaatttagaacatatgacaacagcaaaaaagtcagcatgtggataaatagaataaaggattctaaaatccatgtattatctaggaggtaaagatgttaatattaaaccttcataatttgattaatgttgtagtttataggatagccagtaagtaatagaaatacacacaatgtaagactcccaaaatggtagaagaaaaaatatgaaaggataaaatatactcaacaaacctaaatgaaagcaagcaaagagagataaagaaacataaaacaggtaggaaaaatagcaagataagatggtatatttaaattgaaatataacagtaatcatatgtaatatgaatggaccaaatatttcagttaaaagacaaagattgtcagattgataaaaaagcaaaagtagctgggtgtgatggctcacacctgtagtcccagctacttaggatgctgatgtgggaggatcacttgagcccaggaggttcagcctggacaagatagtgagacttgtctctttaaaaaaaaaaaaaaaaagcaaaagtaaattgtgtgcattttatgagtcatatctaaaacattagatacagaaaagtagcaagacaaaaatgggaaaagaaattatgcaaatatctaaaagatatcgattacagctctattgatagcagaaaaatagactttaaagcaagaaagtattgctgaagattaagaatgtgatttcatggctggacgcggtggctcacacctgtaatcccagcactttgggaggccgaggcaggtggatcatgaggtcaggaaattgagaccatcctggctaacatggtgaaaccccgtctctactaaaaaaaaatacaaaaattagccgggtgtggtggcggacacctgtagtcccagttactcaggagggtgaggcaggagaatggcgtgaactcgggaggctagattttaacacatctctcgtcaattgatggaacaatgtatagaaatagaacaattaacatgattcacaagtttgatcttatagacatatttagaaaatagcaccttgaaattgcaaaattacaagggtggttccaacatggccgaataggaacagctccagtctacagctcccagcatgaatgacacagaagacaggtgatttctgcatttccaactaaggtaccaggttaatctcactgtggcttgtcggacagtgggtgcaggacagtgggtgcagcccaccgagcatgagccgaagcagggtaaggtatcacctcacccgggaagcacaaggggtcagggaattccctttcctagccaagggaagctgtgacagatggcacctggaaaattgggtcactcccatcctaatactgcgcttttccaatggtcttagcaaacggcacaccaggagattatatcctgcacctggctcagagggtcccacacccacggagcctcgctcattgctagcacagcagtctgagatcaaactgcaaggtggctgcaaggcagggagaggggcacccgccattgctgaggcttgagtaggtaaacaaagcggccaggaagctcgaacttggtggagcccaccgcagctcaaggaggcctgcctgcctctgtacgctccacctttgggggcagggcaaagacaaacaaaaagacagcagtaacctctgcagacttaaatgtccctgtctgacagctttgaagagagtagtggttctcccagcacagagtttgtgatctgagaacggacagactgcctcctcaagtgggtccctgacccccgagtagcctaactgggaggcacgccccagtaggggcagactgacacctcacacagctgggtacccctctgagaccaagcttccagaggaacgatcaggcagcaacatttgctgttcagcaatattcgctcttctgcagcctctgctgctgatacccaggcaaacagggtctggagcggacctccagcaaactccaacagacctgcagctgagggtcctgtctgttagaaggaaaactaacaaacagaaaggacatccacaccaaaaccccatctgtacatcaccatcatcaaagaccaaaggtagataaaaccacaaagatggggaaaaaacagagcagaaaagctgaaaattctaaaaatcagagtacctctcctactccaaaggaacgcagctcctcgccagcaacggaacaaagctggacagaaaatgactttgacgagttgagagaagaaggcttcagatgatcaaacttctctgagctaaaggaggaagttcgaacccatcacaaagaagctaaaaaccttgaaaaaaaaggttagatgaatggctaactagaataaccagtatagagaagtccttaaatgacctgatggagctgaaaaccatggcacgagaactatgtgacgaatgcataagctttagtagccgatgcgatcaactggaagaaagggtatcagtgattgaagatcaaatgaatgaaatgaagcgagaagagaagtttagagaaaaaagaataaaaagaaatgaacaaagcctccaagaaatatgggactatgtgaaaagaccaaatctatgtctgattagtgtacctgaaagtgacagggagaatggaaccaagttggaaaacactctgcaggatattatccaggagaacttccccaacctagcaaggcaggccaacattcaaattcaggaaatacagagaacgccacaaagatactccttgagaagagcaactccaagacacataactgtcagattcaccaaagttgaaatgaaggaaaaaatgttaagggcagccagacagaaagttcgggttacccgcaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcttgccctacaagagctcctgaaggaagcactaaacatagaaaggaacaaccggtaccagccactgcaaaaacatcccaaattgtaaagaccatcgatgctaggaagaaactgcatcaactaatgagcaaaataaccagctaacatcataatgacaggatcaaattcacacataacaatattaaccttaaacataaatgggctaactgctccaattaaaagacacagactggcacattggataaagagtcaagacccatcagtgtgctgtattcaggagacccatctcacatgcagagactcacataggctcgaaataaagggatggaggaagatctaccaagcaaatggaaaacaaaaaaagaaaagcaggggttgcaatcctagtctctgataaaacagactttaaaccaacaaagatcaaaagagacaaggccattacataatggtaaagggatcaattcaacaagaagagctaactatccaaaatatatatgcacccaatacaggagcacccagattcataaagcaagtccttagagacctacaaagagacttagactcccacacaataataatgggagactttaacaccccactgtcaacattagacagttcaacgagacagaaagttaacaaggatatccaggaattgaactcagctctgcagcaagcggacctaatagacatctacagaactctccatcccaaatcaacagaatatacattcttctcagcaccacatccaaaactgaccacatagttggaagtaaagcactcctcagcaaatgtaaaagaacagaaattataacaaactgtctctcaggccacagtgcaatcaaactagaactcaggattaagaaactcattcaaaaccgctcaactacatggaaactgaacaacctgctcctgaatgactactgggtacatagcgaaatgaaggcagaaataaagatgttctttgaaaccaatgagaacaaagacacaatataccagaatctctgggacacatttaaagcagtgtgtagaggaaaatttatagcactaagtgcccacaggagaaagcaggaaagatcaaaaattgacaccctaacatcacaatttaaagaactagagaagcaagagcaaacacattcaaaagctggcagaaggcaagaaataactaagatcagagcagaactgaaggagatagagacacaaaaaaccctttaaaaaatcaatgaatccaggaactggttttttgaaaagatcaacaaaattgatagaacactagcaagactaataaagaagaaaagagagaagaatcaaatagacgcaataaaaaatgataaaggggatatcaccaccaatcccacagaaatacaaactaccatcagagaatactataaacacctctatgtaaataaactagaaaatctagaagaaatggataaattcctggacacatacaccctcccaagactaaaccaggaagaagttgaatccctgaatagaccaataacaggctctgaaattgaggcaataattaatagcttaccaaccaaaaaaagtccaggaccagacggattcacactcaaattctaccagaactacaaggaggagctggtaccattccttctgaaactattccaatcaatagaaaaagatggaatcctccctaactcattttatgaggccagcatcatcctgataccaaagcctggcagagaaacaacaaaaaaagagaattttagaccaatatccctgatgaacattgatgcaaaaatcctcaataaaatactggcaaaccaaatccagcagcacatcaaaaagcttatccaccatgatcaagtgggcttcatctctgggatgcaaggctggttcaacatacgaaaatcaataaacgtaatccagcatataaacagaaccaaagacaaaaaccacatgattatctcaatagatgcagaaaaggcctttgacaaaattcaacaacacttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgttcgcagacgacatgattgtatatctagaaaacaccattgtctcagcccaaaatctccttatgctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatatgaaggacctcttcaaggagaactacaaaccactgctcaatgaaataaaaggggatacaaacaaatggaagaacattccatgctcatgggtaggaagaatcaatattgtgaaaatggccatactgcccaaggtattttatagattcaatgccatccccatcatgctaccaatgactttctttacagaattctaaaaaactattttaaagttcatttggaaccaaaaaagagcccgcattgccaagtcaatcctaagccaaaagaacaaagctggaggcatcacgctacctgacttcaaactatactacacggctacagtaaccaaaacagcatggtactggtaccaaaacagagatatagaccaatggaacagaacagagccctcagaagtaataccacacatctacaaccatctgatctttgacaaacctgacaaaaacaagaaatggggaaaggattccctattgaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattgacaaatgggatctaatgaaactaaagagcttccgcacagcaaaagaaactaccatcccagtgaacaggcgagctacaaattgggagaaaatgtttgcaatctattcatctgacaaagggctaatatccagaatctacgaagaactcaaacaaacttacaagaaaaaaagaccccatcaaaaagtgggtgaaggatataaacagacacttctcaaaagaagacatttatgcagccaacagatacatgaaaaaatgctcatcatcactggccatcagagaaatgcaaatcaaaaccacagtgagataccatctcacaccagttagaatggcgatcattaaaaagtcaggaaacaacaggtgctggagaggatgtggagaaataggaacgcttttacactgttggtgggactgtaaactagttcaacaattgtggaagacagtgtggcgattcctcaaggatctagaactagaaataccatttgacccagccatcccattactgggtatgtacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaggatctgttcatgtcctttgtagggacatggatgaagctggaaaccatcattctcaaaaactatcacaaggacaaaaaaccaaacaccgcatgttctcactcgtaggtgggaattgaacaataagaacacttggacacaggtaggggaacatcacacaccggggcctgtcatggggtgggtggacaggggagggatagcattaggagatatacctaatgtaaatgacgagttaatgggtgcagcacaccaacatggcacatgtatacatatgtaacaaacctgcacgttgtgcacatgtaccctagaacttacagtataataaaaaaaaagaaattgcaaaattacacattctttgtaagcacacaaaggaaacatgttagaattttccattttaagctacaaataagctacaaataaagtagtctcaaatttcagataatataaaacatgttttctggtcacaatacaattaaagttgatataaataagaaagataactataaaatcttcctatgttagaatcaagaactatacttttaaacccatgtgtcaaataagaaatcataaattagaaaatattttaaactgaatgataacaaggcatgacatattaaaatgtgggaatcagctaaagcaatatttagaaagaaatgtatagcgttaaaaacatatattggaagagaagaaagcctgacaattaatgagctaaggtatgtctcaagaagctagtgaaacagcaaaataaaccaaaaggaagtagaagcaaggaaataataaagatatgaagtaaatgaagtaaaaaagaaacatacaatagagagaataaagaaaaccaaaagttggttccttgaaaattgacaaacttctggcaagagcaatcaagatgaaaagaaggcacaaataatatcagaaactttaaaaaactggacatcaataaagatcccacaaaaatttctgccaatataaaaatataaaaaatgaggatacttattaatattaaatgttctttcttgttgtatttaccagggattaatccattttacctaattttccaaacttagtgttaaaaggttattaatttaaaaaatccagatccagatggctacactaactatattctaccaatttttcaaaggagaaataatattaaccttgcaaaaattctttcagaaaatggaaaaagatggaatgttattcaattatcttatgataatagcataaccttgacaaccaaaccgaacaagaacaatattagaaaggaagataataggcccgttttattcataaacataaatcccaaacaaaatattagcaatatggatccaaattggatttatgctaggaatgcaagtttggcttatacattagaaaactgatataatttatcacagtgacagactgaaggattatacatattggctgtcctaagcagtgcaataagatgagaaaaagaaggaaaatatgtaaggattgaatatgatgaaacaaactcattgtatgtggaagatatgatggcatagatagaaaatccaaaggaatttatatataaattattagaatttttaaaatttttcaagcttgctgaaaacaaaataaataccaaaattaattgtatttctgtatacctgaaacagttggaaaaatagttttaaatagcatttaaaaattccaagcaggagttgcacattcctgtcagataatggcagctgcctaaatctctccacagtcttcaaaaaccatacatacacatacacacacaattttaaattatgactaaaaccacccataacccatctatagaataaccagaagacaaaaagtactataagtttatatttacaagtagaaaataaatatataaatctagccaaccttgctccagagagaaaccctgtctcaaaaaaaaaaaaaaaaaaaaaaagaagaaagcaaatgttggaaattaactgtcctataaaaacaaaagtgaattactaaatcacaagacccacaaacctctttggtcacatctattaaataaattacacttccatttatcaacagtagagggtactcctggctaagaaacctagtaagccacccagccctcatgtctgcctgcataaatcacctcttattgctgaaacaagaaaatgtaaggaatttctaaatgaacagaaaatagcatatgaagcagatggtattaatgttcttgagtttttattccctctttccttgaaaacctcatcaactttaggcatggccgtacggctcatcttgatcaatagaatgtgattggacatgacatatataccacttccaaatagaagctttaaatgtgattttgtgtttgacacactcttttgtgcctctgctccaggctccagactttaagcctctagaacgataagtgaataaatttcttttgttttaaaggcaccaagtgtgtggtgaatttgttacagtagccctagaaatctaatactaacaaaaagaatgttagagttgaattagaagtgtcagtgagaacttaggaatttaaaaaatcatattcttagcactgttcactgagggaatctagaagtaattacactgcagtaataacgagcccatcccatgcccaaatcttggtctctaactaccattttccagtcaaaagaatctgagctccctagagaaatgactttttcaaggctggatcaaggaaactgccaggcaatcttagatgatcttggtgatcttgatgtgccagaagattaatgggatcatgtgaaaagaacacagaaactggtctgaagggcttcctgttggccagatttgagacaatttgagcatcaaaaggaataatgagggtaatggatcataactggaaaatcagtttgcaaccatcaatgtacttactattgaatacttgtaaagaactttaagggttgctaataccattggataaaagcttgttgtgaaacagaatatttgcatggtctcaaagtctcactccacagattgttaggaaagggaaagggttacctttataaatatagagattaggtggacatcttaaccaagtgatcaaacttagcatcatcaataatgggacaatctggcatcgcatgccccctgatttaatgcagtaaggattaagtctaacaaaagatgtacaaagcctccaaatacagcgtaaacatttgtaaaataatctcagaacagggaccttaatgtttctcaaaaatttttccaaatacagaactttatttctatagatgtttatggtatatttgccatgctatatacattatgctatatattctatgtgctgaagatacaacaatgaccaaggtctttgcccttgtggaactgacatttggtggcggagacagaggaaacagtcaataagcatgtaaagagataaaggaaaagatactgaatgctacaaaggaaacaaataagttgagatttagaacaaaaaagagtcctattttacaagaggaataatgaggaagacctttctaaagaggtagctcagcactttgggaggccgaggcgggtggatcacgaggtcaggagatcaagaccatcctggctaacacagtgaaaccccatctctactaaaaatacaaaaaatgagccgggcatggtggcgggcacctgtagtcccagctacttgggaggctgaggcaggagaatggcgtgaacccgggaggcggagcttgcagtgagccgagatggtgccactgcactccagcctgggcgacagagcgagactccgtctcaaaaaaaaaaaaaaaaattgaggcagaatttcgctatgttgcctaggcttgtctcaaactcctgggctcaagcaatcctcctgcctcagcctgctgagtagctgggactccaggggcatgccactatgcttagtttaagaggtggtatttaaactgagacccgaagggtaaaaaacatggataaaagaagaaacagaaggggtaagagccttccaagcagagggaatcacatatacaaaggctctcatgttaaataaaacaagagttgacattgttgagaaactgaaagatcagctcatctgcgatgcggtaaaataggaggaatgcagtgggagaacagatcagagacttgggcaggggctatattaggcagaacttggagaccagagtaagggggccaaggtgggaacagaccgattaaattggcatctcttgggggggtgggggggtggggaacttacccatgcatcattttttaaaagctccaaaggcgattccaataagcagccagggttgggaacctagggggaaaatgtagctagatgaatgaagatggcccaaacgtcttttgttctgatagctaaactctctgtaggatcacagtgttacttcacagtgcatttgccaggaaaagtctcttcccatttggaatccgaagtaaaactgacaccacacttgaagatgccaggattgttagaggaaaatgtcacccaatagctccaggaagcaggagccctactgttgctgtttaaccacttctttcccattttggtggcaagttgcctccttttacacaaactgcctcaggagatcctaaagatatcatggtgtctgtctgtccttgcaagagcatgcattatggtaggacattgccttcattctgttcctttttctccaagactcttgcttattctcaccatttggctggactttctactgtaggattacctcggaatccacacaaaacccacagggtttcagagttgccttgaattacacgttttgaacattcagatcttcattttcccaaacatccacccagttataggtgacctttgctccaaagtcctggagtagcaaggtgccttgagtcttagactcttcccacttctttctctcttctgcatcccctcctgccaaggttgcccagccacactaaattgcatgccttgctgtgttgcattcgttatcattctaaagttgtcaccaacatgtgcgaaaccagtttatctaataacgatagctaccattttctgagctcttgccatgtactcctcttgccacagcaaatgcattgacaagggagtctgctggccaaagcctgactctcatctccagatggtccaacacagatgctgtgtgtgacccaggacaaagcacttaatgtcactgaggtttgggaagtgggtgagaacactgtagatataaggcctagctagagtgaaggcctccaaagcagggtgctcttaattctagatgtcccagatgcgtaggacagagtcatctagtcatcttccagggtttaatcctggactactggaaacaactagaagtgagaaaagcgtctgtgctttgcagtgaccattgtcctgtcagacaaccaataaatgctatctttcctctttcaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggagacaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttgataatcttattttggcattcttttcccattgactatatacatctctatttctcaaatgttcatggaactagctcttttattttcctgctggtttcttcagtaatgagttaaataaaacattgacacatacaaacaaatgcctttgagaattgtgtttttacactggaaataaaaatgtgaacactgatttttaaaacaaataggggcactgaatagcaagatggacactctagaaaaccaaattagtgagttagaaaaccagattaaattgaactcagagtaaaaatgatataattcatgagagtctgaataaaataaatcagaaatggagcctcaatccaggagaacagcttatatggagagagagagactgagagagaaatgggagtttctgttcaatgggcataaagtttcagctatgctgctgggcacagtggctcatgcctgtaatcctggcactttgggaggccaaggcgggcggatcacctgaggtcgggagttcaagaccagcctagccaacatggcgaaatcccgtcgctaataaaaatataaaaattagttgggcatggtggcacatgcctgtagtcccagctacttgggaggttgaggcacaagaatcgcttgaacccgggaggcgggtggaggttgcagtgagccaagatcgtgccgttgcattccatcagcctgggcaacagagtgagactccatctcaaaaaaaaaaaagtttcagttatgcaagatgaattaagttctacagatctaatgtacaacattgtgcatatagctaacgataccatactgggcacttaaaaatttgttaagagagcagataccacgttgtgttcttactacagttttacaacaatgcaaaaatgcattgtaaacactatgtgcaaatagaatagcaaagaatgtatacagtgcccatgagcataacattctagtggacccacaatgcatcagagttcagtgagactcaaagggagaagaatgttggcaaagtcagtggggaggagaaaatgagtgtgatgaaataggcggtctcattaaacttcccttacaaaacacaagatcaaagataaaattattaagaatttcgagacagtgacatcagagcaaacgaaacatagg

SEQ ID NO: 4 - DNA, 188930 bp, Artificial Sequence
  synthetic construct
tcaccatggctacattctgatgtaaagagatatatcctatacctgggccaaatgtaaacagcctggaaaagtgttaggttaaaaacaaaacaaaataaataaatgaataaatgccaggtggttatgagtgctattgagaaaaatgaagccaagagggatatcagtgatgcaggtgggggtaaagagcttacaacataaatgtggtgttccatatttaaacctcattcaacagggaagattggagctgaaatgtgaaggagttgtgggagtggaactacgtggaaatctgggggaaaggtgttttgggtaaaagaaatagcaagtgttgaggtccaggggcatgagtgtgcttgatattttagggaagagtaaggagaccagtataaccagagtgagatgagactacagaggtcaggagaaagggcatgcagaccatgtgggatgctctaggacctaggccatggtaaagatgtagggttttaccctgatggaggtcagaagccattggaggattctgagaagaggagtgacaggactcgctttatagttttaaattataactataaattatagtttttaaaacaatagttgcctaacctcatgttatatgtaaaactacagttttaaaaactataaattcctcatactggcagcagtgtgaggggcaagggcaaaagcagagagactaacaggttgctggttactcttgctagtgcaagtgaattctagaatcttcgacaacatccagaacttctcttgctgctgccactcaggaagagggttggagtaggctaggaataggagcacaaattaaagctcctgttcactttgacttctccatccctctcctcctttccttaaaggttctgattaaagcagacttatgcccctactgctctcagaagtgaatgggttaagtttagcagcctcccttttgctacttcagttcttcctgtggctgcttcccactgataaaaaggaagcaatcctatcggttactgcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaaggtaaaggcatgtcctgtagggtctgatcggggccaggattgtggggatgtaagtctgcttggaggaaggtgcagacatcgggttaggatggttgtgatgctacctgggccccaaagaaacatttctgggtaaggtgtgcacacatctgtgttattagcagaaatgctaactgccaattcttttcataggtctgacctatttgttgatattttgttctgttttgtccattgcttctcttcgtcatatgctgctcctccagaatctagagactggagtagagggagggtgaagggacaaagacaaaacttccctctgcctgcccaagcttccatagagagaatcaaggcaatgaaatccaatcaatatcacacacaagtttcatgtctggttctcttgtgtgtacatgcaatgtgtgtttttataatatcttttcctactttgggtgtaaggataatatgagccttgagttcagaagcttttcgtgttttgggggttctggtgcatttaggcagagtattaaataactttatcaatattgtctatggtcatcagttgattcagatttttctacctcttcttcagtaaatattggtatattttggtctatactttcatagaaagcaatctactgtccctagatttgataatgtattggtatcaagttatgtaagagtctcctgtgattttgttaaactgttctgtgtctgtagttatattttctttttcattccttatgttgtatatgttctcttcctctcttttaaaaataatatttccaggagttttcttgattttattggtcttgtcaagaattttcttttggtttgatttatcaatctcttttttctttctgttgcatcagtttctgcttctactttcattgatttattccttccttctaatttcctttggttcattttgttgttagatttttgcttcttgagttgaatgctgaaatcatttattttatttttttgtcttctttaaatgtgtattataaagatttaaatataatacatagattgtggctgtgtaaacattaaatgtggtcatgttgtacatactttatattctttttggttctttctgtttggctccccaccctctttccacatcagtccccttctcccccacctcagctaggtaaccccagtatgataatatatattcacatacacatacacacacacaaaggttttcttggacattatttgttttataaaattgggacattatacacacatttctcactcattaacacgtactagaactctaagtcaattggtatagctttaattcattatttttattggctatataagattctatggtatggctgtatcacaatttagtcaatatgttcactttattccagtttttggctactatatcctatatcattacatactggtgcttttacttctgttgaacaaacttgcaagaggaatattaatggaacgaagggaatgtttccttctaagttttaatttccaaagaggtcagaacttttcaaacatttctaccatcgaagtatgaaaatggccttctctctgcattcacatagcgataagttttatcctgtttttaaaatttgccaattttacaggtgtagagtgatattgcatcattactttcattgtgttatttttatttctaataagttgagcatctttttaaatgcttgttggctattggatttatttgggggatttaattagtcatatgatttgcccattattctttggactctttcatttaaaaaaattatgagaacccttttattattacaaatattaactctttgtcatgtatattgcagttttccccaagatctattgtttgtctgttgactttcttataacttttaccaaaacagtttttaatttttataatcagagatatcttttctttcatatcttcagagtcggcaaggttggttaaaaatgtttcccacacctcaagattgtacgtgtaatctcccagattttcttgcaagatgtttactgtttcgctttttatatgcattgcttcaattatctgctaattacttttgtcatatggcatgagagagggatttgtctagttttatttccatccagatcaatagcctattgtgatggcaccttttgccactgatttgaatcaacacattcatcatataaagttctcatatatattagcatatatttctggattcattaggctgtttcactaatctactattatcttgctatgccagtaccatagtgatttgattacagtgagcctatgatatcttctgatatctggtgggtgaaagcaatcctcactattctttttgtacctttcttagctattcttagacactttattcttccacataaaactgttaagatatttttcaaattaaaaagatccaagccctgttgtgattctaactgcaatttcattaaactcagaccttaattttattaatgtaataaatttaaatatttttcttattacatttatctctgtgtattttataagtgtgatgctattgttaataagatagttttctcctatttccatttatgagtgcttagtaccaaatagagataagctattggtttgtgtattttcagctttttcttttgagcctgggtctcattttgtcacccaggctggagtgcagtggggtgatctcaccttactgcagcctcaacctcctggattcaagcaattctcctgtatatcagccccccaagtagctgggactacaggagcaggccaccatgcccggaaaatttttgtatattttttagagatgggtttttgccatgttacccaggctggttttcaactcctgagctcaagcattccccccacctcagcctcccaaagagctaggattacaggtttgagccaccgcacccagccattgtatattcatcttaaatctagctaccttaccaaatttgcctattaattctagtaattttaccctaaagtctctgtgagtattgaatcatatcataagttaaatgagacagattttagctcatttccaatatttatagccagttatttcattttcttatcttattgaatttattagaaaacaagagcaaatgttaaataataacaatgaaagtgaacattccttctactctatgattttacttgaaataatttttgtattttgctatttagagtaacatttgctgttttggtttttgtaaatggtgtttattctattctcatttgccacaaaatgtttatcataaataagttttcagcagctggtatcatctgaattgtcttctttgatatgctgatgaacaaattatgttcatagatgtcctgacactaaatacccttacattcttggagtaaaatctactattcatggaatttgatcattagtgggttctatgtactatttctttagactattcttagtagattttcactactcaacctactaataataataaacaaagttttgttggctttatcaaatgaattgatgagtactccatctttttctattgcttagaatagcttaagtaacatttgaattatccattgtctaaaagttaggtgagactcacttatgaatccatttggtcctagtggcatttgcaatatctttaatcacccctccaggctcttctatgataatcagtcaattcaagtttcaacttccaataattatatacctttctaggaagtaactttatttattttttcaattttgttgccacagtgttgcatgtagcactcactcatgattcttttactccacattatctgtagttatgtgccctttcttattcctaaattcctctatctttgctatttatctttttttccttgaataagcttgccaatgacttgtctattttgttgctggtggtgctcttttcaaagaatgggcttttggattttttttttttctagttggtataaagcatttttattttcactgagcagaaaaagaagctattgattcattaactgtgctgctttattggcatgtagctatgcactgttcacacattaatatataaaactcgtcagtctgttttattttgtctgatgggaaaacatgaacagtgagatttcttatgcaaaaagtgaacagttcaactatgctagctccatatacctttattaacattccagagacttatcctctcaacatgatctgatttctgtaggataacttttcaggaaaagtattttctgatcagtgaagcttggagatataaataagcaatcggccaggtatggtggttcatgcctgtaatcccagcactttgggaggccgaggcaggcagatcacctgaggtcaggagtttgacaccagcctagccaacatggcaaaactccgtgtctaccaaaaaaaaaaaaaaaattagctgggcatggtggtgctcacctgtaatcccagctactgaggaggctgaggcaggagaattgcttgaacctaggaggcggaggtggcagtgagctaagattgtgctcagcctaggtgacagagtgagactccatttcaaaaaataaaaaaataaaaaaaagcagtatctctcatattcattaactggaccctgactttcttaaagctcaccccaaagctgaagtccatgaaggcactagttctcaaacttcagtgtgcataagaatcactcgggaagcttattaaaatttacattcctaggccccatcctcagcaaactatttagtccccaggtaattctatcccaccccaccccagctttattgtggtataattgacaaataaaagttgtatatatttaaggtgtacaagataatgttttgatgtaagtatacattgtaaaatggtatagcatgaagggttttcttttcatttttttcagaatagtttgtaatatcttctttgatttcatctttgataatctagacgtatgattttaattgctttttaaatttgtttatcaagttagtttgtagtatttgggtcaacattgaatatcctgttaatttcctattgctgtgtaacaaactacatcaaatgtatcagcttatgacagacccatttactgtctcacagtttctgtgagttagaagtccaggtggactcagctggatactctgtgcagggtcatacaaggccaacaccaaggttttaatagggctgcactccttagtgaaagctcttggggagaatctgcttacaggctcatttggaatgttagcaaattcagttccttctctcactttccatgtagtgccctctaccagcaatggtgcatcaacactctctcatgcttggaattgctctgacttcaattttccgtgcatatctctggccttttttgcctctctcttttacttttaaggactcatgtgattacattgggccgacctgggtaattcagaatactctccccatctcaaggtcagctaatcagccccttaattccatctgcaaagtttaatttgccacataatatatttttggacatgacaccaaggagcaaaggtgatgtgggccaaatttttacctgccacaggtatagtttacatacaatgaagctcatcaattttaaatatgcagtttgatgagttttgacaaatgcatacacttgcataaccaccaccctaatcaacatgcatttacatcaaccctcctgcaactttttaatgagtctctcccactgacctggcctcagccaataaactgctatctggaagttacagatttgttttcacatgttctagaattttacatcagtggaatcatacggtatgtattcttctatggctttttttcttcagcatcatgatttggaaattcatgcaggttgttgtataaagtatttctatcctttttattgctgattactgctccattatgggattatatcataattttggattatttccagttaggagcaaatacaaataaacctgctatgaacagtgctccacatgttttgtgtgaacatctattttcatttatcttagttaaatatctaggagtggaattgctggatcatatggtaagtgcatgtttaagagaaactgccagacagatttcttgaacgtaccattctatactcccaccagcaatgcatgagagttccagttgcaatatatcctggacaacatttgatgttgccagtacttaatgactgcacagtggtatctcactatacttttttttttttttgagatggaatctcatcccatcacacaggctggagtgcagtggcgcaatctcagctcaacatctgcctcctaggctcaagcaattctcatgcctcagcctcctgagtagctaggactatggtcacacgccaccgtgcccagctaatttttgtatttttggtagagacggggttttgccatgttggccaggctggtctcaaactcctggcctcaagtgatccacccgcctcggcctcccaaaatgttgggattacggcttgagccactgcacctggttatacttttaatttgcgtgtctctgatgactaaagatgttgagcatctttgcatgtgctaattagccattcctatatcttcttggaagtgtctattcaaatcattggtcctttgtttttaaacgtagtttcaacttttattttagactgaggaggtacatgtgcaggtttgttacatgagtatgttgcatggtgctgaagtttgggttacgaatgaatgatcctgtcactgaagtagtgaacatagtacccaataggtggtttttcactccttgctacccttcctcctccctctttcctctagtcgtctccagtgtctattattctatgtccatgtgttctcatcatttagctcccacttctaagtgagaacatatggtatttggttttcagttcctgtgttaattcacttaggataatggtttgccagtttttaattgggttgtttgtcttgttattgttgagttttgataattttttatatattctgggtacaagactattcagaggtacctgttttgaatgtttttttccaatctatggcttgcattttcattttccaaatggtgtctttcaaatagtggaaatttatagttgtagttaagtccaatttagcttttcttcttctatgattcatgcttttttttcccctgtcctaggaaatctttgcccacctcaagttcacaaagcctttcttctgttttcttctagaacttttatcattttagcattagtatttaggtttataatacattttgagttaaattttctgtatggtgtgacttttctttctctattgaattcccttggtgcctttgtagaaaattaaatgactgtatataggcaaatctgtttatggattctctagttccatagatgtgtatatctgtgcttatgccagtaccagattgttttgattgttgtaactttatagtaagtcttaatatcaggcagtctaaaacctccaacttacttttttattgaaattgcttttgatatatttaggcttttatatttctgtattaattttatagtcaactagccaactccaccaaatagccaactgggattttgactggaattgaattgaatctgtagatcaatttggggagaattgacatttaaacaatactgaatctttcaatacaacaacatggtatggctttgtttctttaaattttctttaatttccctctaggatattttgtagcctacagagtagttcttgcaagaattatattaattgtatccccaagtattttgagggattcgatgctattgttaattgtatcatttttatttgttttcgttttccaatcatttgttactaaaatatagaaattcaattgatttttgtatattgaccttgttcactctaatcttgttaatttgcattttagctctagtagcgttttgcacttcttttagaatttctacatatacaataatgttgtctgcaaataaagacagtttgcttcttcctttccaaactggatgctttttattttttttttcatgccttactgtactggcaagggcctccagtacaatgttagatagaactgatgatagcagaatccttgtcttcttcctgatttcagagggaaaatattcattattttaccattaagtacaattacttgtaaattttttcatagatgccctttgtcaaattgaggaagtttccttctattcttggtgtgagagtttttatcaagatttgatattagattttgtcaaatgctttttctgcatctattcaaatggtcatatggtttatcttgtttattctgttatggtgaattaccttgattgattttttaatgaggaactagctatgtattcccagggaaaaaatccacctggttgtgacatattacattggtaatattttcgctatggactgaattgtctccacctccccccaccccaaattcatatgttgaagtcctaactctcaagatgattatatttggagatagggcttttaggaggtaaacaaggttaaatgaggccataaggatggagtcctaatctgataggactggtggcctcataagaagagagaaggttctctctctacactcatgcactgaggaaaagccatgtgaacatacagcgagaaggcagccatctaccagctgggaagagggctccactagaaactgaccgtgctggcaccctgatattggatttccagcctccggaactgtgagaaaataagtttctgttgtttaagtcacccaatctctagtattttgttatggcagccctggccaactaaaactgttttgttaagggttttggtggtgatggtggttttttagtttttgcgtctgtgttcatgatggatatttggctgtgattttcttataatgtcattgtctggttttgatataagagtggtattagtccgttctaatgctgctatgaggacatacccgagactgggtaatttataaaggaaagagatttaatggactcacagttccacatggctggggaggcctcacaatcatggtggaaggcaaaggaggagcaaagacacatcttatatggcatggtggcagacaagagagcattgtacaggagaactgccctttataaaaccatcagccctcatgagacttattcactataatgtgaacagcatgggaaaaccccactgccatgattcaattacctcccacctggtccctctcacagcacatggggattgtgggagctacaattcaagatgagatttaggtggggacacagccaaaccatatcaaagagtaagactattctttttttttttttttttttttttgagacggagtctcgctctgtcacccaggctggagtgcagtggtgcgatctcggctcactgcaagctccgcctcccgggttcacgccattctcctgcctcagcctcccgagtagctgggacgacaggcgcccgccaccacgcctggctaattttttatactgatagtagagacggggtttcaccgtgttagccaggatagtctcgatctcctgacctcatgatccgcccacctcggcctcccaaagtgctgggattacaagcgtgagccaccgcgcccggctgactattcttataaaatgagttgagacgtgttcactcttctatttaatgaaagagtttgtgtagaattggtatcatttcttttttaaatgtttattcaccagggaaatcatcttatcccagtgttttttgttttggtttggttttttttttaagggtcttaattgtgaattctatttttaataggtaaagggctatttgaattttctatttcttataggataaattttaataatttcttttaagaaattccatttgagactgggcatggtggctcacacctgtaaccccaacactttgggaggaggcagcaggattgctctaggccaggagtttgagatcagcctgggcaacataacaagacttgacttctacagaattttttttcattagccaagtgtggtaacatatgcctgtagtcccagctacttggaaggctgaggcaggaggatcacttgagcccaagagttcaaggctgcaattaactatggatcatgctactgcactccagcctgagcaacaaagcaaggctctgtctcaaaaaaagaaaagaaattccatctgagctgttgaatttaatagtataaagttcagaatatttccttaccattttttcactccttggaggtatgatttacatactgtaaaaatcacttattttcagtgtggagattcttttcctttcctaaatctccacatttttattgacatatactttacatatcataaaattcaccatttgaaagtgtacaattcagtggtttttagtgaatccgtaaagtgtacaactatcatctttatttaattccagaatattttcatcacctcaaaaagaaaccctgtaatcattaaacagtcacttctaattttcttcctttccccagcccctggcaaccattaacctactttccgtcactgtggttttgcctattctggatatttcatgtaaatgaagggataaaatatgtggccttttgtgtctagcatcttttgcttagcatgttttcaagattcttccatttttgcagaatgatagaggagttaaaataagaaaataaagatatagtaagaatgaaactattttcattttttaatttaaaaaaatcttccatgttgtagtatgtatcagaatttaactcctttttatggctgaataatactccattgtatggatagaccacattttgtttatccattcatctgttgatggacttttggattgtttccccttttggctattatgaataatgctgctatagaacattcatgtacaagtctttgtgtacatatgcttttatttctcttcggaatatacttaggaatataattgctaggtcacatggtaattctatgtttaacttttagaggaactgccagactttttcaaagcagctgcaccattttacattttcactaccaaagtatgagtgttccaatttttccatattcttatcaacacttgttactgtctgtctttttaattatactcatcctagtgtggataaagtgatatctcattgtagtttggatttgcatttccctgatgacttacgttgttgagagtcttttcatgtgtttattgaccatttgtgtatctcctttggagaaatgtctatttaaatgctttgcgtgtttttaattggattatttgttttttagtactgagttgtataagttctttatttattcttaatattatacccttatcagagctatgacatgaaaatattttttcccattctgtgggtagtattttcactttcctaatagtatcctgtgatgcacaaagtttttcattttgatgaaatccaatatttatttattttacccctttggttgcttgtatttttgttgtcatatctaagaaatcaatgtcaaatcaaagatcactaagatttaaacctatattttcttttgagacttttatagttttagttcttacattgaggtcattgatccacttggagttaattttggtatatggtgtgaggaggggatccaagttcgttctacagcctatatagcctgcagatgagcaatgttagtgaccttgaaagtagaggcccaggttgtcagtagcctggcatctaactaaacaaccatttatccattaaagttagccctgttaacaattaatattgagataattttacttaatacactgtgtatattagtgtccatctagcatgcagcctgaggcacagagaataatagtttgagtataaaattgaattgaatggaatacatcattaatttattatctagctttctgttattgtataggcagtcacatgtatttaccagaaaaaagttgatagaatttttattttaatgaaacccttttatactttagattattttgatgctgattaacaggataagctgactctggacacatcctgacagcctctgccaaggtttgaaataaacagctgggaaaattcagttttatattatctgttcccgcagctgctcagtttcttctaaccacaggtcagggaatataataggttttccgattagttttagataaaatgtgaaagaacagttcatgtcaaggacaatggttgccaaatatatttggcaggatttctatattgaatcccaaaggaaatacacaaacaaaaccccacaaaagttaggaaggagtaaaacccaggaaccctggaacattttgtcatttactatgcagatttgcctgaaagtgagacaggcaaataaatcacatgtttctgccagcgtggaaaatattcactcaaatggcaaaggtctcaggctggggagctggatattgtcctgtaataggttcatctcagaactgaatcacacacttggagggtgttaatgctcttaggaacatctagttattccctttgaatagagtcctgtcctgaatcacatatacttgacctagggcctaggcctttttgtttttctgtctcacaatcttgtttctccatcaattatgtgttttcactcttccctcagagagggaaaaagtgtttctgtgtgctcttgatcctgttccctctctgatcttccaatctattgctctataacatattttatatgtgtcttatatcttcattttagtcagaaacatttatttatttatttatttatttattttttgagacagagtctaactctatcccccaggctggagtgcagtggcatgatctcggctcactgcaacctctgcctcccgtgttcaagcgattctcctgcctcagcctcctgagtagctggcattacaggcatgccccaccacgcccagctaatttttgtatttttagtagacagggtttcttcatgttggcccggctggtgtcgaactcctgacctcaggtgatcctcccgcctcggcctcccaaagtgctgggattacagatgtgagccattgggtctggcctttaatcagaaacatttaaagtgaaagcactgtggtaacttatgttgaaataccttagaaatcaatggaaactgcacagagagggggtaggatagacgtagtggaaccaaggatatgatatggaaaaaggagaaaggtagcaaactagggatgagttggtgaatgtggaagggcataataatgttaaatgactgaaaactacataggcttatgttaagactagtgccatggaaatttttagaggtagatgacattagagtatgtttaaatataaattaatgttcttgcagtgagccgagattgcgccactgcagtccgcagtccggcctgggcgacagagcgagactccgtctcaaaaaaaaaaaaaaaaaaattaatgttactggttgtgttccctagatgtagactctgagatgaagattaacatgcaggaattttatttggagtgttcttgggatcaacacctgaggaatcagggataggcagagggagaagcgcgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccaatggctgggactggggagttctttcctagactgccatccgggcgcccctcaccctcttgctgctcagctccaggtcgtcgtgggttcagggctcagctgcacgctcctgcccgcgccctgggcgtgatggcacccccagcccctgccattcttccccctcaccccctctccctgccactgctctgcattgccctgggttagcctggcggggccaggtggcacccgccgtatactcttgcctttctgctgcaggggcctttctgctgcgggtcccagagctgcagggaggggcggcagagactccccacgtggctcattggcgggggtgctaatcagagttcttttgctgccactctttgattcccaaaccccatgtaatcttcttagtggggacacagaatcatctttgaattcatacatatacagcaccttggaggctggccctccatcctcacagagacctgcctccaagctggagttctacctgtgcctggttgtggacccactccctcatctcttttgctgtacaatgattccccaggtctacacggtgctatatggaattccacatcagtgaatcaaatcctctgtaagatttcagatagtggtgctggctaaggccctgaagggaggaaaggctaagttacgccaagattaggtatcacaatgaagtcctgtcctttctaggatggaaggagttcagtgtgtctggccaccgagaagctggtttgtctctgtgatggacaataccatattgcagcaatccccaacctttttggcaccagggactggtttcgtggaagataatttttccagagactttggggttgttgggaatggttacggcatgaaactgtccgcctcagatcatgcggcattagttaggttctcataaggagcacaaaacctagatcccttgcatatgcagttcacagtagcattcgcactcctatgagaatctaatgcagcagctgatctcacaggaggcagagcccaggcggtaatgcaagtgatggggagccgctgtaaatacagatgaagctttgctccctgcctgctgctcacttcctgctatgtgaccccattcctaacaggccacagaccagtactggtcaggggcccaggggttgggcccaatatggcatattgggagctcagcattgatttttgttgctggcaggttggactttggtggcaacagtagctagatcagccttagtcagtgggaagccacgcttttgggtccatgcattaattctctccctgctgctgtagccacttagctcatgtcttgccagtactgcgatggcctatgcagaggctagctgatgtgaattgccagagtcatttttatatgtgttgttggtttgtgcttccttcaagatggatgctttctgttggcattaacgtattacttggagatttttctagtttgtgtccactcactaatatgcctttgtcccaacttttttctggaagagcttccttatcagtacgctgggccctggccctcagccagtacagaaagtcatttgtcaaggccttcagttggcagacgtgctccctggactacgtgctttctcgggtgtcccagaaaccctggaatggagtgaaatgcagggctacgtgggagagcagggaggcaagaattaagtcggccccacctttgcccaactcagtgggtctccttgagagaggtctgcagtttcaaggagacttttcagccaatctgctgcgagatcctgtgaaggggtgtgaaggtcttcctctgtgactatagattggccagtctctccttgtgtgtccaacagttttcattatactttatgtgaattaatgcaaaactgctaggtttaaactgctcaccattttagggatcccttctggattttaccttccttaaggggaaattttcctcctttcctcagttcatcctttctgccttggctttgacgtggtctggaggccacagagcctcctcctgagaacctctctctggtgtgtctgtttgtgtccgtccctctcctttcgatcattccctgtggttcctgttgggcgcggctcccataaacgcacagagcagggtctgctttgtctgcaacctgatgcattgttatttctcaccaaaacttgcagtccaaacatcacatttccgggccacactctttgtcagagctccaggggcacaaccccggggacctgctggaaggtgccaccgtgacgtgtgcctagatgcgttttccctcagttaccacagcgttcctctggttctggtggctggagggtgaccgcgtgcttcatgaagggggtccttactgcttcgcatccacccttttcacggaaagcactttgtcacatgttttcagtgtttctaagcgattttctgccaatcttgtgtgctaagattgtgtggcagcgtttccacagatttatagctggcaatgaattctcccaaaggaaatcagacaaaataaaatgtttccaacattgttcacatactgacaacttatgtgcttccttgggtgattttacaactttttaagcacatgaataaaaattattgtctgcttttttctccttttttctctcttttttttcttgcatgcagaaagtttataggagggggatcctctggatcaacacccatgggggagtgaaggaagcaggattgggtaaaagaagttgaggtgatacagtctgaataaaggtcagtcccacagggagctcaagctaggatggctctgcagagatgttctctattgaggcaagttgtctggacctatatagtcccacctttaccaggaataaggcatgagtttggatgtggtgactgacttcagccaaaattggttctcagagaggaattcagattagagttgtcagctgtcagcacacccagcagcttaggaaataagtgctttagtcctgaagcggtgaatctggacaccagcctccactgtggtccaccctttctgctgctcagattcatttgcttcataagttctggaatggttccttcaggattctgatgggctccctttcctggggaaacaaaagagaaaggtttggaacacagcacaactcctgctgctttagcttttcttgagtctgcaactggtactcatcatcttccccttctactacccattctagatccctccccccaccaccctctcaattcatacttctgctgctccaagtgggttaccagataaggtatctggtcatcatgccctttgtaagccatgactgtacttgtccatttatcatcaacattgaacaagggaatactaagagatacccaggcagatgacctggctgccaaatatattctcctctgtctccattgtgtaatgtcagcccttcctcctgatgatcaggatcggttacgcttgccaggatagtgactcttttccttacctcttggtctcttaatagtgatctgaagtaatatgatggcaaccatagtttcaagtttaatgagactcttggtgtgtccactggcggacatattccccttttaagaaccagtacttctaaactctcagagcccagagttgggataagaggcatagtttccctaattgggtcactgggagtaatggtagtgtgaggctgctcctacttacactccttgttttccaaaaccatatattttacttcgggacacaccccactaaacgatggccattgatctagagtatatactgcatcctgcaggatggtgcctcgtccttaggtattatgtctaagctagtgcctcagctgtgccttcaacaagctgtcctaccactctatcaagtgggtagcttctgggtagtggattccatggtcatgtatcttcttgctttaaagtaggtctcttggtctgatgcagtgttatgtaagatcaaatattctgtgaggccttgaatggtggtgtttactgaggctcaccaagcaactgaatgattttcttgagaaatggtgacatatcagagccttagctttggtctctgttactggcaagttgaacattaacaacatcagtagctagatctgtattgatgagtccatgatgttgggcccatgcatagcctctgccatggctcctcctttcatacatccattttgtaagaattggggcaccaacagcagagactggtaagcatcaaagtggctaagtcattcagtctacttggttgtttagtgctgtttctgtggctgatgttcttttcatttattcattctgtaatgcgtatcctttgtagattcaatttccttctctctgaacaacttctttggatatttattgaaaggcaggtctactgtcaataaattccttaatttttattgtctgagaaagtttttatttctccttcatttttgaaggatactttcacagagttcagaattttaggttgactgttttttctttctctcaacactttaaatatgtcagtgcactctcttcttgtttgcatggtttctgaggcgaagttggatgtaatttttatctttgctcctctatggataaagtgtttttccccatctggtttcttacaacattttttgtctttgattttctggagtttgaatataatatgcctaggtgtagggtttttttatttgtttgctcgtttgcatctatctttttttttttttttttttttttgagacagaatctcgccctgtcacccaggctggagtgcagtggcgcgaactcggctcactgcaagctccacctcttgggttcacgccattctcctgcctcagcctcctgaatagctgggactacaggcacccgccaccacagctggctaattttttttgtattttttagtaaagatggggtttcaccatgttagccaggatggtctcgatctcctgacctcgtgatctgcccgcctcggcctcccaaagtgctgggattacaggcgtgagccaccgcgcccagctgcatccatcttctttggtattctctgagcttcctgaatctgtggtatggtgtctggtgtctgacattaatttgggggaaattctcagtcattattgctttaaaaatttgctcctattcatttctgcattcttcttctggcatttccattatgtgtatgttacaacttttgtagttgttgttccacagtttttggacattctgggcccatgcatagcctctgccgttgttgttggtgtttttttttttttcagtctttttttctctttgcttttcagttttgattggaagtttctattgtcatgtcctcaagctcagagattctttcctcagccatgtctcatcaaccaatgagcccatcaaagacattcttcatctctgttacagtgttttgatctctagcatttcttttttattctgtcttagaatttccatatttttccttatgatatacatctgtcattgcatgttgtctactttttacattaaagccattagcatattaatcatagtttaaaaaattcctggtctgataattatgacattcctgccatatttgactctgattctgatgcttgcttgttcagtctcttcaaattttgtgggttttgccctttagtgtgccttgtaatttcttgttaaaaggtggacatgatgtactggctatgaggaactacagtaaataggcccatagtgatgtggtgagatggaaagaaagaaaagatgctcaacatcactaatcattagagaaatataaatcaaaactacaaagagatactgcctcacacccattaggatggctactatcaaaactaaaacagaaaataatgaatgttggtgaggatgtggagaaattggaacccttgtgcactattgcaaatgtacaatagggcagtttctctaaaaattaaacagaattaccatatgatccagcaactcgacttctggctatatatgcaaaagaactgaaatggggtcttaaagagatatttatacatcaattgtattagggttctccaatgaaacagatccgtgtgtgtgtgtgtgtgtgtgtgtgtgtgtgtgtaaatatatgccaatggtaaaagtacagggtctgagtcagaaggcagaaccaagaatgcttatgtccaagggcaggagaagacagatgtcccagttcaaacagggagagtgaatttgcccttcctctgtctttttgttctattcaggccctcagtggaatggataatgcccacccacattggtgagagtgatcttctttaccaattcacatgctattctcttctggaaacatcatcacagacatacctagaaatactgttttgccatgtatctgggcatctcttagcccagtcaagttgacatataaaattaaccatcatatccatgtttataagcagcattattcacaatagctaaaatgtggaagtactgcaagtgtctattgacagatgaatggataatctaaatgtggtatatacacacaaagcattacgaaagaaggaaattctgacacatgctacgacatagatgaaccttgagtatattacgctaagtgaaataagccagtcatgaaaagacaaatgctgtatgattccacttatattgggtacttagagtagtcaaaatgatacagaaagtagaatggtggatgccagagactggaggaggtgagagttattgtttaatgtttatacagtttcagtttacaacataaaattaattctggaggtagatgggagcatattacacgttttctttttggagatgggatctcactctgttgcccaggctggagtgcagttttgtgatcatagctcactgcagccttaactgtctgggctcaagtgatcctcccaccccaggcaccaaagcagctaagaccacaggtgcacaccaccacgcctggctaattattattatttgtagaggccaggtactgctgtgttgcccaggctggtgttgaacccctgggctcaagtgatcatcctgccctggcctcccaaagtactgggattacaggtgtgtgccaccacacctggccagaatatttaatgctactgaactgtatatttaaacatgcttgggctgggcatggtgcctcatgcctataatcccagcactttgggaagccaaggagggtggattgcttgagcccaggagtgtgacaccagcctgggcaacatggtgaaaccctgtctctacaaaaacattaaccgggcatggtggcacacgcctgtagtcccacctactctggcggctgaggcgggaggatcactcgaacccgggaggtggatctcgccactgcactccagcctgagcaacagagtgagaccctgtcaaaaaaaaaaaaaaaaaaaaaagatttacgatagtaaattttatgtgtattttaccacaattattaaaattgaagaaaatccccatgggtcactggtttaccaatttagccattttcaccatttttagattgcattttccttctctatctcagcattctgactaaaggaaaagcaaaatttcttacaagaatgaatgattctccagtgtggctgctcctgaaaggaacaatgagacttttgttatttcaccacaagactgagaaagaaataaacaagtgataaatgcccagaccccttcttattcattccacatcctggtaatctgaggcatggtgtggcttttactccaagcatatgaatacttacaatcagaagctgcctctcctttccctcactttatcattattgccatcatttatgacaatggagggagtgtctcactggatgatatttggggttctttcttcagtggtccgccataccaagcatttatttgtgctgttctccatctttcacatctaccacttttcaaaagtccctgagagtcaataagacatgcgactcgaacaactgcttcacatctaagtgtatgtctttaaaaatctctccttttccatgtttatgtctgatgtgttttgttatggcaaagtggcatgtagtatacggttcataagtgaatcgatgtatatctgtggagggcaaatgctcaattttagatctacacatgaaagcttttttccagggcaggagccttgctttctccaactaagccttaattacccaaatgcccatgtgttgtgcctttggcttgttgaaatgataccaactggtaaaatctgatgggagataaaagttagatgtccagaagcataaaagtcaggaagagaggctctttatggcatagagaaagctgcagaactgctccatggtgtgcaaaactcatcagcacatgaaactagtgagtggagatagtcaccttcaaccactttgtaatttctaccaattcacttggggccagtgtcccttattcaccaagattcacattggtccttttgattatttggcgtgaggaggcccccagacatgctaaactgtcatgcagggagagaggaaaagttgggaaccagcctttgcttaaaagggctttgacaatggaggcaaataataacattttgggaacatttatataagtaattatataatttctgattcagtagctggttcatgaataaatgagtaattgggagtatctgagtggagacaagaatgaacattaatgtaggactgattctgaattacagcttctggcactagtaggtttcaatatacatagtctgctgaaaggtaattttctctgtgatattcctggtatccctaaggagggaagtataattttaggtacatactgacaaaatttgaacacaaggtacttagatgaaagttatagtctgttttagagatgaaattgaaggatgcagtagctattgctttggcaaaggatttttggctgatgcagtgtatggttattgattttatgattcttatcatatggcacctaatgtatcagttgagttgtgaaaacagtgtttcggtttaatggatgttagggatttatatacaacttcaaatttgcctccttgctaatagtagaaaagagtagtatggaagcattacttccagctgctttttgaagtgtccaccaaaatgaacgactttttcctttcttcacgcagatttcctcctagagtgccaaaatcttttccattcaacacctcagtcgtgtacaaaaagactctgtttgtagaattcacggatcaccttttcaacatcgctaagccaaggccaccctggatgggtaatgaaaacaatgttgaatgctatttatgaaattgggtatcttattttctatcacagattccccaatcttgaggttgcagttaaaaagtgcagctgccaaagagaatgtttccctaactgctacctatagggaaatacactgactgcattttctgtctttttgctgggccgtcttcctctgcttggtctatgccaactgcttacctccacttagatgtcaaataaagtatgtaacaacatgttatgacaggacattttctgtcttagaattgttgctgagaattataggtgggaagtatccccttattctaaagagagatatcagcctatcgatttagaacttgttcaggtagtagtccaaaattggttctgcaacccttaggccctgactcacctccaaccttgtataaaaaaaggctaggaacttatggaagactttagatttgaatatttattatttggagagcctcttcggtgttttatgtgttgcttaccccatggggagtgggaggcctgtccctcatgtcaaggtataatgaaggaggcttcaggagaaccacttagaagactggacaaggtacctatggaacttgggagacactgaccactgcctggtttttatctggataaattttcaaggtcagaggccaaaaggacttctcctgatggaatagcagggggagtgggcaatagtgggagctaactgcactaccattgttaggtgtaaggccaggaaggtcactgaatgggacttgtcttacaaagactctgcctgagaggtcttcctgccaggattagataaccccaatagaaaaagcctgtatgggttgtactgccagaagcagaatctgagaggagagatacaagtgaccagctggagaaggtatatcccatgccaagatcaggagcagtggggtgtctccttgttggcagggagaggtctccaaataactcataagttccctaagaaagaaaggcagaattttggtatgtgtcacaactagggagtactaatgccacattatcactgctccttccaagaaagactttgtcattgtgcctatttgtttttaccctcccccctcctttccacttgctcctaccttggcaggtccagagacacaaaggtgagttggggaggaagattaggagaggaaggtgggaaagcagcgaagctgccaaaacaaattacctttacatattgcagatttctggggctgtcagaatgtagctggagaaggaagggaacttgcaattgcagaagacatcaaaaatttggtattagactggactggacttgttagaacctaagagtgatactgttggttaatacctgaaggttactggaaaagatttgggatcaaccaaagtgcaagaaaagggagatctcacataaagtaattaaaagcagtggtctaagaaaaataaggctattttatgtttttatcccactcaatccagttcattcaacagactgtttataggcattttatacttagtgtattcataaaacagagctcttaattttcctcctgattttctgtcatggcctgactaacaacccagttgcacaagccaaaatcataggagttttctttgactcctctctttttttctatctccacatcatatttatgagcaagtcctgttgactgttcctccaaaacaagttccaagtcttcttattttacttcttgtaaaatccaaattcatccaaattcctgtggcctgcaaggtcctacatgttatgtttcctttttgaccatattttctgttactcctctgctgattcactgtgcttcagccacactttacttgactataccaaacttatttctgcctctggacgtttgcatttgttttatctgttttcaatgctcttccactagatctttgaaaatcttgcttctttttcattagtcagatctctactcaaatgtcacctcctcagagaggcccttcctgactactacactgaaagtatcctctacctcctgcctcatcactttctagcagaccactatcttttatatttataacaacttgaaattttcttatttatttctttatgtgcttaatgtcttgagaatatgatctccattatctgtcttgtttgctactgcacctccagtgcataagacagttcctagaatatagtaggaactctagttgaatgaatgaatgaattgaatgattgccagaaatcttgcctcagagcaaccataaggttaggctgatgttggcagcaagcaaatactactttttgtcagtaattacaggggcatgcttctccactgtgaccttgactctaacttttggaataacaggttttctggagtactatccccaagtaacctttggcggacatctcattcttacaggtctgctaggtcctaccatccaggctgaggtttatgatacagtggtcattacacttaagaacatggcttcccatcctgtcagtcttcatgctgttggtgtatcctactggaaagcttctgagggtgagtaaaataccctcctattgtcctgtcattctatgaatagaacagtgagatgtgtgtgctttgtaatggtggcgttacaactcttttaaggtcctaactgaacattatgtgtatttcttaacatttactagattataaatatctcaagatagggaaatccatcttatttattgctgtgtccttagcatataacatattgcctaccctatagtagatactcaatacaagaatgagggtgtagtggacaccagtcattttttcttcctaaaattaaacatttctcacctgtataccccctaggaattgcttttctgaatatacttcaaacagaacctgccattttcttaaagcccatgcctccctagccatagcagttgatctaggagtgagcagttgacacgggtatcccacctccttggccacagttgattggtccagagatgggcaccttacccaagctaggccaatgagagtacttgcactagcattttgaaatttatgagaaaaaggacctattattaccaggtaatcctatacttaggggatggagcccaaatataataaaatcaagattctactacttcatgtatatcatgtgggccatggatcttataggagtcttaagggggtgttggtcttgtccttttcttagttgcctagctctttgcaggcatggtgcaaaggcaggacaatctacctttatctgctccttctataccactgatcctaccctaaacatgtagctgtataatcagagacaggaagccatggcaaatctggagggtctcggcttggctatatcttaaagagttacatgtattcgtagttcaacattggggaaattttccaaaaattggtggagaaacgagtggccaatgcaattttatctttttttttctgctgacatcagggagagataagagctttaaaatcacaattatggggagataatattttaaaatccagctcaagttaaacccatcagaaaaggtaacaccttttgggacccccaaatggccacatcttatccaatgaggggacaccaaccatagagtctatactgcacagttcaaatggtagccatgagctatcaggcacttgaaatgtggtgagtcctacttgagacatactgtaaaatatacaccagatttcaaaggttaagtacaaaaaagactaaaaatatctcattcattgtttataagtacaagttgaaatgcttatatttggatatactaggttaaacgaaatacattattaaaataatttcacctgtttctttttacttttcttaatgtgactaccagaaaatttaaaattacatatgtggtttgcattatatttctattgaacagtgaaatgtttagcatatgttgaagttgctgctcctgatgcagtggctcatctcagatttggccaagttcttctgtccaaggaaaactaggttcaacccattcctggagaggaacagactcaaatctttctgggctgggtcacttaccttggttaaatctgttctccacctattctaccaacaaccaaagggatggacatagctgaaataaaaatcacgcaatcacactgaatggtatctcacctcaggtgggccttcagcattgcctagccattctactgctacatttcccctaatccatttactctccctctccccaagacagctataatgtttcacacattgttagcctctcattgaacctccaacatgtgctcccgcccctgcccccaccacaacgtgagccttgggaaaaagggtatttttttcctaatgaaatatttcaaacaaagataaatacagaaaataatataacaaacaaacatgtgcccatcacctcactttgccaaatcttaacattttgtcatctttgcttaatttattttacaaaattaagcattttacatacagtctgtactcctctatggggctggcaggaaaaggctctcattgtcaaagttcaaagtaattgatcattgaaaaaataatgatcacattaaaaacaacacttatataatagagatacatattgtaatactcataaatgaaatgatatcctgtctaggattggcttcaaacacatccaagctgatgttacaatcattaggtgaattcctgatgtggaatttgacatttgtatggcgccaaaataatatcccagtgatttttttctgattgtaagtggaaatgttaactttagaatggaggtatcaggctaatccacaggtcagttttagtgtcactaaggatgggatggccagatattatctgcccctgatatggcacaatatgagggactcagcatcatctttgatatattttagccaaaaaacttatttaatttgaatctaatcagaacttaggcatattcaatagcatgggatattctacaggactacaagccaaatttctttcaccaaatgagtgtcagaaaaaaagggactactccatactaaaagagactatgggcctaaacaaccagatgcaatctgcagtcttaggttggattctgatttggaccaactagctacaaaggatgcctttgaggcaattaagaaaatttgaatattgcattgatattaggtgatattaactggatcaggtgtgctagtgtcattttgtttatgtgggcaatttttttttaaagatgacttctaaagtatataggagtggactatcatgaaatttgtaatgtacattaaaatgcatcatcataaaaagtgtgttgaaagaaaaaagtgaaagtagcagtgcaattctaagaataattttctaacatccactcacaaaaatattaaattctttatattaaacacatgaaaaagaacacaaatatatctgtctttcaagattcatctcaaattccacctccttcatcaagcattactgaagagtaggaagcttgtttactttttttatccactgtgttgctcgctccaagggcatagagacttctatcttgatctttatattttcagcttgtagctgagtctggtaaagaataagaactcaataaatatttgtgaataaataggtgaatatttccacatggtattataattatatctttatatgtctatgtcccccaccaaacatagtgttgtaccactaggaaagaacaaagtttaagaaattttcttaaatctctctttcttactgttccgtgaccctcactagtgcctaccaaagagtctgtgacaaagtgtatttgttgttgaattgaattaggcaaaaagatgcaataatggaagcaatttattatttaacagaatgtggagatatcaaccagaacctagtttttactgctcatgctagggttagtgatctcaagatcctctggagtatatgaagcttctccccatttgtggctgctgcttgttagtttttcaaattaagatgcagaaagtaggccgggtgtggtggttcgcgcctgtaatcccagcactttgggaggctgaggcgggtggatcacaaggtcaggagtttaagaccatcctgaccaacatgatgaaaccccatctctactaaaaatacaaaattagccgggcatggtggcacgtgcctgtaatcccagctgctggggagtctgaggcaggaaaatcacttgaacctgggaggcggacgttgctgtgagccgagatccagcctgggcaacagagtgagactccgtctcaaaacaacaacaacaacaacaacaaagatgcagaaagtccgtttcttatgtagaacctattggtgacaataaacttgacatgtttctttgagtgtacagtggatatagaaaggacaattttatttcttcctgctataggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaaggtaagtgtatgaaagcgtaggattgagatgaaataagcagagaagtacaaacaactgaatctatctataacagttagcatttgtgttccttcacctgaaagaggcttttttactctagcatcatgctcatggaaaggagaataatccagtttctgagagaagcagatatgcattctatataaccacaataaactctaagctgggatcaggaggagctgagttccagaattaaatctctctcctcaaagcattgctattttcctcttcaaatctgtgggctttatcagtagtgatttctactgtcctctgccttttgcaaactttgagctaggttccttgaaaacttcatggaggtaaacacatccaagtgtgtgatcaatggcatatagactggttcaggtggttagtttgtcatctgtaaaccaaaagtatataaaaatctaagaaaagtcagcatttatttatatgttactgaaaattaattaatttggattgaattaatatattctaaaataattctaatcaaacctgtttttaatttataccttagcataaattagggaagtaaattttgcataatttgtttttatcctattttttatggtgaaatcagcttcactgtaccttttccttgttccatttatcttttactgcataactccacaatttagtggcttaaaacaacaacagtctcttattatctctcatggtttctgtgagtctcatggaatttgtcagtgttttgacttggtggcctatctaagtgtgtctcatgaggctgtagtcaaacagtggctagagctgaaatcatcccaaaggtgactttattcacatgtctttgaccttggcttgatggtactctccacatgatctctctcacatgggttttacagggtagccagacttcttatatggtcctgagatagcccattagaagctgtttcacgatttctaatgtaaccttggaaatcactcacataacctacattctattagttagaatgcatcactaagaccagtctataaagggagactccaccttttgatggggaataggcaaagaatttattaacaggaatcaccatactctttctgaatggtgatgatgaatgtgattcaaaaaaaggatgggagcggggagtggagaagatgagaaaggtttgtagtttataatagtttcagatgaaagtatgatttctcatatactgagttcagtttcatagtcataattaatgagaaagtgccaaaaccacagtgtattatttatgggatgtaaaggctaatggaacaatgagatcatcaaaacattagtgtttacatatgacatataaagaaataagttaaaaacccaaatgattctttgacacagagttgaactaaagagtctacagaggttctagttccaggtgaaatggataaacacactccaccctttatttcccattgaacttaactataaaaccttgacaaaatgcaaagcccagatatttaaaaatttctaaaaagcaaatagaacaagtatatagagaaaagacactagaattgaaagtattaccaaacttgtgggggagtatacctttttccccactctagtattccttaacctgaattaaaacataactggagacttcgaagtgagtactatgttgcaaagagagctccaggacaaaccctctggggtttcaaggagtgagaaaggtaactctaaatgctcagagagcgtgggaggggaaatcccctagggtttttgtcctcttttccaccattctctcaagcttcagtcccaggttgcctgtggcaatgacagtggctggcaacagaaacctgccggagtaaaaacttagggaggggaacattattcttcattcagtacagctacagatctaagacattgggggaaaagcacattactttctctctgtctttccccttccattgcttgaccttagctatgatgtagttgtggaaattggaagcttctggttagaaaaccaaaaaagggagctcacagaactggaaagtttatagatgacagagagaaaagatcccaggaaagtaaacccataaagttgtgcattaactcctggattcacccccaacctacacatccaggtatgtagtttcagtgtcagatctgttttaaaccccttgcagtgccattgagtccaacgcagtggccagtctggtgcttgaggggaaatctcagtttcacagtcttcaacatgttccattagcctttacgtcccataaataacacactgtggttttggcactttctcattaattatgactatgaaactgaactcagtatatgagaaatcatactttcatctgaaactaacgcccacagaattccttaaaacatgtctgatggctgaaagcaaagatagaacattgtgagataggttttttaatgtatggtagatacaatacataaaagaatcatagcataacaagaggagggtaaggaaaactttatggtccattcaacttcattccaattcaaatggtaaaatgttgactctaagtagatgatagtgaaaggttaagtatgtattttgtaatccctagagcaaccaataaaaaattataccaagagacacagtaaaaagtcacaataaactaattacaatggtatatcaaaaatattcaaataactcaaaagaaggcaagtaaggagagatgaaaatcagagagaagaagcagtaaaatcataataaaatgataggcttaaatctaaacatatcaatacttacattaagtgcaaatggctaaaacacaccaattaaaaacagagattagcatactggatataaaagcttgaaccaattatatgttgtttacaagaaactcatttcaaaaaaatgatataggtaggttaccagcataaagatggaaaaggatatatgatgcaaacatgaatatgaagaaagttgaagtagtacaaatctgtaatcacaacattgatttttgccaggagtgccaaaaccattcaataggggaaagaatagtgtcttcaataaacagtgctgaaacaggtgaatatctgcatgcaaaatactgattgagtatcccttacctgaaatgcttggaaccaagaacgtttcagatttcagatactggaatatttgcacatatataatgagatagcttggggatggaacttaagtctgaatatgaaattcattttggatataaatcccttgccagttatgtgattggcaaatattttctcccactctatagtttgttttttcattcttttaatggtgtcttttataaagcaagagttatatggacaaacatatgaaaagatgttcaacatcattaaccattagggaaatgcaaattcaatcaacagtgatgtatctattagaatagctaaaataataatataaaattgccaagaatcctgtcaagaattcagagcaacagaaagtttcacaatgcacaatggtatagccattctggaaaacagaatggcagttttgctgcttggtagagaaacagtctctggcagtttcttgtgaaattagatgtacactatagagggatagcaggagggagttctttttggatattgaaatggatctgtatcttgacgatgatggggtttcatgagcttatatctttgttaaaagttatagacctatacaccaaaagaaaaagtcaatttcactataattgaaaatttatataaaagtaattagaatgttttaagacagctttatacgtattttaaatgtgtctctaaagtttttaatccagtacttctggtaaagatggcacagggtcttcctacttagccatttttccatcctccacctcaaccccaacctcgctgaaaaccaacaacaaagataggtaaaccataaatagagaaaatcgaataggcatggtcagctgaaaaagaagataaatatttgtggaccagaagcagaacaggaactgtgagtagtaaaaggggtggaaattacaggccaactgagatctgggtcaggaagccagctgcggtagccaaggagtcaggatgacaaggataaatagtgctccccaccagagggactgagagcccatatcatagagttgggctcttcttcacttgaaagagagctgagcacagctgctgctcactctttgtttagggccatggctttgtggaaactcagagtcctagaagaggggaaagcaaacccagtcctagaataggaactgaactaagttttcttggttcagtgggggaatctgcaatatccccaaggtttccattggccagtatctccaaaattccattctagggtatgatttgctagatagagaatagtgaacacatcctttgcttaatcaaccaatgatcacaagggacagcaaagatcactatagttcaacaaagtcagatttattggctcatggcaacaagagactgtggacacctccctaaacaaagggaaatactgtatagagttagtaaagaattttggggaagggtggaggttaggtgatatttaaatgaagcaaagtagagttgtgtgtaaagaaataaccatgaggtctagactgtgaagtgttctaaaaagttaacatagacatgaaaggttaagtcaaggcaccccttacctgaagcttgagctttaaattgagctgcttctttgtgtcaaagtaatttagatgacctaggaaagaatgagatgtttcattcttgttgctattagttcaaacatttctggcaggctgtgaattcagagaacaaacaactcaattgagtaagaaagcaagagataatcaaagcaaatagttggcattcagtgagtttatacagtggcaatgtgtccttgggagaaatggtgttgttaactctgcagttagctttatctatgtctcttatcccagcctgatgagtagcagcacacgtactgttgctttcttagtccaagctaatttttatttctaagcattaagggtgcgagagagagaaagaacggcaaaatgtcataaacaaaaatctttctactcaaaataagcctgtaaacaaaagtttccagtcaaatttaaaaaatatataattctaagaaagatagccaacaagctcaacagttaaagcatgaaacaagctagtttgttccattaaaaacttcagctatcgatatacacggtatttatttaaaatgtgagtataattagaagcactgtgggctattgaaaaaaaatcatgagtatagatgtttaatatggacaattgctattttactcaaaacttttaatttacaattgcagaagtataaaaagttacaagagtaacagaaattatctataatttcactattatcacacagtgtgtgagggcttgtattttgtaagtgtttttaatttttttctttagtaattcatttttatcatattttacacaagtagtggtcttcatcaaagttgaaataaaaaaattctttgctccagatagttttagaaacactgctataggagacctgacatcaaagccaagttatcaagagacagaagactacatttgttcttactgtcaagtaactgatgaagaactgtctcctcctagtgacaatttcctacaatgagattttttaaatagaagataaatgttctcacttctttttcagggagtctggccaaggaaaagacacagaccttgcacaaatttatactactttttgctgtatttgatgaaggttagtgagtcttaatctgaattttggattcctgaaagaaatcctctgctactattaagaggaggtgattatagaaagatcataaattacattactgttcaggaatgaaggagatggggttaaaaatgaattccaagaaaacaaaacgtaacctcagttccactggcagctatgaggtaagaagatagaggagctggataacggactggcctcatccccctcattaagactgtcaacaaatactttgggctctactttctaaatactttctcttatcttcatctattattaagtgcacaacctttggcaagttatttaacctctctgtgtctcggtttcctaaatggaaataatagtacatttttcataagattgttgtgagtgctgagtgatttcacttaagtaacctagagcactgtgtggcatagagtaggccctcaatagtgttagtacctccgcctcttcctcctcctcctaatgtaatcactatgtaatcatagtaacataatattcttcttgcccccttatcaatttacattgccatcttcttaattgaggccctcatgatctgtctcataactctcaaaggaagcttactgaagtgagtatctgatcttgtcactctagcctctacaatacttcagtttgccagtttcggtggctcatgcctgtaatcccagcactttaggaggctgaggtgggcagattgcttgagcccaggagtttgagaccagcctgggcaacagggcgaaaccacatctctacaaaagaattaaaaaatcagccggtcatggtggcgggtacctgtactccagctacttgggaggctgaggtgggaggatcacttgagcccaggaggtgaaggttgcagtgagctgtgattgcgccactgcactccagcctgggtgataaagccagaccctatctcaaacaacaaaacaaataaaataattcaatttcaaggtaaagtgcaaaatgcattatctattctctggtgacatttccagccttgttgtgttccatttcctgccttatcttccatgtcacccaaatatgtaatgctttttcttgcatgagacctctgcatatgcagtttcctctgcctggaaaaatctgtctccctctttacactaagtaagcttctcctttttctttaagtctgacttacttcagttatccccttccttaattccttctcccaggatgacctctagtctggattagatgcctgcttatatttccacagcatcttgagcttattccttatcatactatatcagtattttctactttatttaatatttatcttctttgatctcatatctttttcccttcaagcaaagtgaaatttcttctcctctctgctccctgtaacaccctactctcatctttattatatcactctttactctttattataattatcagcttctctgacgattccagctagagtgtaagcatcttgaaagcagaggctgtatcttcctctctatcatcagtgtctacaattagtagtgctcaataaatatgtgtttgaatgaatgaacaaatgaatggctgcctcataaagttttagcactagctaccagtccttcacacaaaggggtaactccagggagtcactgttcaatagtatttccagtgcttcagcccttatcaatttcagagacagtgttagggagctttcaggttcctggggtttcataaatataagctgggatgaagcaattataacggagacagggactgacagacagcctttttcctaggacaattttcttttttcttttcttttttttttgagatcgagtctcactctgttgcccaggttggagtgcagtggcacaatcttggctcactgcaacgtccacctcccaggttcaagtgattctcctgcctcagcctcctgagtagctgagattacaggcacatgccaccatgcccgcctaatttgtgtatttttagtggggatagggtttcaccatgttggccaggctactctcaaacgcctgacctgaagtgatccacctgcctcagcctcccagagtgctacgattacaggtgtgagccaccgcgcccggcccctaggatgattttcataagctttcttttaaataattcagctaataaaaagaattgaatcctgatgcctcaagctaaccaatattctgtcttctattattatccattcccacttattgtcatggacaaatggagggagagaaaatcagtttgagcaagagatgtctgcctttacataattatcttctccctccctcacactgactttgagaggataagtgctgtgtgcctactttgctgacaaaaatgcttaaggtgtgagcacactgggagcagggaaggagaaaggggaggcggtcattcatgagacacatgcttagctgactctatctttgccttctctctcatcagggaaaagttggcactcagaaacaaagaactccttgatgcaggatagggatgctgcatctgctcgggcctggcctaaaatgcacacagtcaatggttatgtaaacaggtctctgccaggtatgtacacacctgctcaacaatcctcagggtcttccaaattcagcaccagagttctgtacttcagttcacaaacagctcggcatctcagaggatatagcccactgaatacttgaagatctctggcctctggggatcttaatgtatagtaggcaattcctcttttggtcacctgaaaatgaaggcttacccatgtacatacagcccacagtcagatttttctttccttttcttaaatgtgagtgggcaaccaaggatgaacagacatttaaaaagaacctaaaatatggaagggatatgcaaagatgaacaaagaaaataataatcccagaataaaaaaagctatggctcagaacagaactcatcggaagctcttacttctattttcataaagattcaagaagatactgcatcaataaagtaacaataagatgccttccagttttaaaataggggcatagaggcaggctggctttactccctctcacagaaaaccaaaaccaaacatacagcaccaatatctacaccaacaacaacccagagctcacatgtgaggatgagacagttcccggagccacagagaagtgaaaaaactttgagaatcagacttccacatccatgactctccttcctcctattctgcccagcaccaagtgtatggaaaatctcccctcaactcatggtttctacactggaaaaagtgacattgaggtgttcaaccagcttctccaccttcttgggttccctggggggagatttgtccttgccttaacccacagaaaacatcatgactgtctgaaggcagaaatatcccagagtacaggcagagacaaatgagggaggaaggactaccatccccagccctggaaattctgctctataatttggccaaagacatgcaaattcagaatggccgtgcagcagcaccatgctgtagcaggtttatcctacaggtcaccttggcatgaatcactagctggccttccaacactgctatgataatccctttgggacctcacccacttgggacaggcagggctctgaccacttactggaacacctgtaatcccagcacttgagctcagcacaataacaataggagatggctactaccgttaattttatgcagttacgatttaatactggatctttacgtttgtttacatttgtcccaactggcaccttcatcacctccaccctccccaccccagactatggtaaccacgattctactctctattttcacaagatccactcttttagctcccacatgtgagtgagaacatgtggtattgccctgcagtgtcacctatgttgatgcaaatgaaaatattcttttttatggccaaatagtattccattatgtatatataccactgaactgtacacttaaaaatggtaatgatggcaaattacatatgtatattttacatcaataaaaagaaacttaaaaataaggtaacaataggattctatgaaaaacaatcataacaaaacgtgctcataaaaattataaacacaatggtcaaaatagaaactcaatagaaagtactaagaatagataaaatctttcataaggtcaaacaaaatgtggttgagaatatagttgacccttgaacaatgtgggggttggggtactaaccccctgcacagtcaaaaatccatgtataacttttgactccctccaaattcaagtactaatgacctattgttgatcagaagccttatcaataacataaacaacaaatattttgtgtatgtattatatgctgtatattttcaataaagtaagctagagaaaggaaaatgttatttatacttttctctgcttcttgggagtacttccagcatcactagtggcactttatacgggtcccaagtatccttcaaagtttatggagagatgaaatgcttatgcagagatgattagcatcatgcagagttttcagtggatgcctgcagcactcgagctcagcacaataacaataggagatggctactaccgttaattttatgcagttgcgatttaatactggatctttacgtttgtttacatttgtcccaactgggaatggtgccatgtatggttgtaagtatgtaagtttttataaatttcaactttttataatagatttttgtatattttatggtaataaatgataaaatagtctagtatcaacatgtatatgtatatataagtgtgtatacatatatatatatattttttttttttttttttttgagacggagtcttgctgtcgcccaggctggagtgcagtggcgcaatctcagctcactgcaggctctgccccccggggttcacgccattctcctgcctcagcctcccgagtagctgggactacaggcgcccgccacctcgactggctaattttttgtatttttagtagagacggggtttcattgtgttagccaggatggtctcgatctcctgacctcgtgatccacccgccttggcctcccaaagtatatatatatattttttgagacggagtcttgttctgtcacccaggctggagtgcagtggcacaatctgagctcactgcaacttccccctcttgggttcaagcgattctcctgccccagcctcccaagtagctgggattacaggcatgtgccaccacgcccacctaatttttgtagttttagtagagatggggtttcaccatgtttgccaggccggtcttgaactcctgacctcgtgatctgcccgccttggcctcccaaagtgctgggattataagtgtgagccactgcatccggccatctccatatattttttgcattcataacatacctttttcttaatttttttgatatttttaccctatgtggtccatctgacagttttttcaaattgtcataaatttccaaaaaaatctcactatatttattgaaaaaaaactgcatataagtggactcatgcagttcaaacctgtattgttcaagagtcaactgtgtgttttaaagcagattttaacatcaagaaatgatagaaaaatgataagaattaaaagagataaatattcatattagaattgcccatcaggagcttctgagtagctgaacgcatggaggttcctggagagtggctggccccatgccccttcccacatacccttccttatatatgcatctcttccatctggcgtttataagaaaaggtgctgactgctgaattataaggacactgtggtctactagataaaggttgaggagaggggtttgggcttctattgtcttctttccgggccttcatctcctgcttgtgattaagtagtgcatgctgagtggagcaaagtggtggaataggactcttcagcaataatctcctcacagaaacatcaaggtaacaactcgatgcgtgaaattaccttcagaagagttaagaaaacctgaacccatgagcaagactgtgaagcccttttggactgcaaagacgagtaaaaccatagttgcacataaaggggattggttctttatgactgagaccccacccgcaagccactgcagtaccacaggcggaaagtcaccatggacccacggtttttacaccggaaaactctcccgtatggcctgagtgccctctgtggatctccactaattagtagcagagccagcatgagacttgcgtctaacctgggctcagggcgccctctcgtgctaaaaggaaatacaacagccagtcctttcactttctttttgatatggtctctgttgcctaggttggagtgcagtggtgcgatcatagattactgcagtcttgaactcctggctgggctcacacggtcttcccacctcagcctccagagtgggactacaggtgtgtgccactatgcctggctaaattttcgggttttgtgtgtggggtggggaagattggggtattgctatgttgctcaggctgggtctcgaactcctgacctaaagcaatcctccagcctcagcctcctaaagtgctaggttacaagtatgagccaccacactcagccccactcaatttctaaacgagctcactgaaatagagcagtcacaaacaaacccagactgtgaacatgagaataaatacctaattcttcaatgtgtagacagggatgcacatctgcaaagaataagaatagcctaagaaagacagcctcaacaaatgaacaaaaaatcgtgccagtgactaatcctaaagacatgcaggtgaatgatctggtagacaaagaattcaaaatagctattttaagaaaactcaacaaacttttataaaacacagagaaacaattcagaagtttatcaaagaaatttaacagagaaattgaaggaataaaaaaagtcagaaatcctggaactgaaaagtataataaaaaatgacacatgcaatacaagacatcagcaacagaattgatcaggcagaagaaaggatcagcaagctcaaagacaggttatccaaaaatacaatcaggaggggcttcaggatggttgactagatgcatctagtgttcatcccttccatggagaggaaccaaagtagcaagtagataattatactttgaataggtcatctaagagagaacactggaattcaacagagcagtgacaggaagcattgaaagcaagggaggagagagaaataaggcctgtttgcctgggattggctgggagtctggaacagcttcctaatgtggggaaaaggtaagagacccttagtgttcctcattttcaccaaggactcttgcaatcctagccacaggagagcgccttattccttgacagcacagagactagcatagggagttgcctaaagaccgtgtgaaggcattgcaacagagagctcacgctggattctgcaattctcccaagcagctgcagcacagcaccattttgagaacacagcccacacatcctgccctgctatgatggccgtgacttaggcaggagccctgagcagtgatcctgccccacccagcagaggagtgcccatgcattttcacatattccaagaacaaattccactacctacaaccactgctgctgcaggctgctgtggggccaaaacactagtgaaccttgtgctcccaagctacctgcctacagctactccctgagaaagcaaccccaccttcaccaagagcagggctatagcacagctactgctgcaccccaacctgagcattttgctagtgacctcggtatcaccccacccctgcatagcacaaccagcacctcacacaccaccaaggagcctgagggcaggttcacgtagcccagctctacctgcccccagtacccaagcatatcatccaggggcctagggatcacttagccctgtccaccactggtggcacctgagcacctcctggggtctgaggtcaggcccactcaacctgccactactgccacagttagcactcactgcatgcaccacttgagggtctggagactggccatgcgatccatagcagccacaaccaacgccagcacagaccacttgagattcaggttgtttcattgctatgattgccatcaaccatgccactttgctgcccaggaacttgagaacccacccacccatgtgatccatcaataccacttctggcacccaagtaaaccacttggaggcccacaaatcaacctgcctggacctaaaaccagtgcaatcatatgccaccatggtacaccaaagacaagcacactcagcccactgctgccaccattggggcctgaagacaggcctacctggcatcccacttctcagaaaaacttcaccacagcctccactaataaccacaccctaagccactgagaaaatcacaaatatcactgatgctgtttagaatcttatacagaggctactacattcaccgagaatcaaaaccgaagtgctctacccaagcaacaccacagatacatcttcaggaaaaagttctttcctacaaaagcaaattttaaaaattggaaaaagtgattattacaccagatgtgcagatatcaatgtaaggacacaggaaacatgaaaaatcaaggaactatgacactccaaaggagcacaataattctgtagcaagagatccaaataaaaaaaatttaagatgggtacaaaaaaatagaaagaatgaataagacctgctatttgatagcacaacatggtgactatagttaataataacttaattgtacattctaaaataaagagtgtaattggattgttaataactcaaaggataagtgcttgagggtatacatacctcattctccatgatgtgtttgtttcacatcacatgcctgtatcaaaacatctcatgtgttccataaatatatacacctactatgtatccacaaaataaaaaaatcatagtttacaagcaaaacagtatatgtgaccattggtttttaagtaaactggccaacatctctttaaaaatttatgaaatcctggaaaaataattccaaattttgatactaaataaactcagtgagatacaagagaattctgaaaaaaatacaaagaacacagaaaaacaattgaggctatgaaagagaaatttacccaagagatagatatcaaaaaagaaccaaacaaaaattctggaaccaaagaattcattgaatgaaatacaaaatagatttgaaaggttcaacaatagaccggaccaagcagaagagtatcagaactgaaatacagatcttttgaaataacccaatcagacaaaaataaagaaaaaagaattttaaaaaatgagcaaagatttcatgacatattaggcactataaagtgaccaaatatttgaatcttcagtgtcccagaaggcaaagagaaaatgaagaggttagaaagcctatttaatgaaatattagatgaaaaatttccaagtctaccaagagatttagacatctagataaagaaggctcaaaaatacccaaataaatacaatgcaaaaaggtcttctccagggcacattatagtcaaactatcaaaagtcaaagaaaaaaatttaaaaatagcaagagaaaagcatatagtcacctgtaaaggagccgctatcagactaactgtgaatttctcagcagaaactttacaagccaggagagaatgagagagagagaaaaaaaaaaaaaaacacctgccagccaaggatactgtacacagcaaaattatccttcataaatgaaagagagagaaaaatattttcagacaaaaaaaaactgaggaaattcattgcaacctgatctgctttacaggaaatgctaaagggagtttttcaaactgaaagaaaaaggtcctaatgtgtaacatgaaaacatctgaaggtataaaacccacaggtaaaagtaagtatcccgacaaattcagaattctctaacatggtaattgtagaacataaatcacttatatccttagtaggaagattaaaaaacaaaacagataaaaataattaccataacctgttaaagaataagcaatataaaaagatgtaaatgatgacatcaaaaacacaaaatttgggagtcgattttttaaaaaattttcttgcaatcaaaattaagttgttatcagttcaaactaacttgttataactataaggtattctgtgtaagcctcatggtaattacaaagcaaaaatttttataatagatacactaaaaataaaaagcaagggattaaaacatactgatagaagaatcacttaaccacaagggaagagattaagagaggaagaaaggaacaaaggatctacacaacaactagaaaacaagtaaaaatatggcactaccaagttcttacctatcaaaaattaccttgaatacaaatgggttaaattctccaactaaaagacatagagtgtttggttttttgttcttgcgatagtttactgagaatgatgatttccaatttcctccatgtccctacaaaggacatgaactcatcattttttatggctgcatagtattccatggtgtatatgtgccacattttcttaatccagtctatcattgttggacatttggaccgcatattctcactcataggtgggaattgaacaatgagatcacatggacacaggaaggggaatatcacactctgggaactgttgtggggtggggggaagggggagggatagcattaggagatatacctaatgctagatgacgagttagtgggtgcagtgcaccagcatggcacatgtatacatatgtaactaacctgcacaatgtgcacatgtaccctaaaacttaaagtataataaaaataaaaataaaaaaatttaaaaaaagacatagggtggctgaatgaatttttttttaaaaaaagatctaactacatactgcctaagagaaagactttacctgtaaggacacacatagactgaaagcgaagggatagaaacagatattccatgcacatgtaaacaaaaagaaagcaggaatagctatacttatatctgataaaatagacttcaagtcaaaaactataaaaagagacaaacagccagacgtggtggctcatgcctgtaatttcagcactttgggaggctgaggcgggtggatcacctgaagtcagaagttcgagaccagcctggccaaatggcgaaactccatctctactaaaaatacaaaaattaaccaagcatggtggcaggcgcctgtagtcccagctactcgggaggctgaggcaggagaatggcatgaacccgggaggcggagcttgcagtgagccgacattgcaccgctgcactccagcctgggcacacagcgagaatctgtcaaaaaaaaattgacaaacaaggccattatataatagtaaagaagttaatacaacaggagaatgtaacaagcataaatatatatacacccaacattggagcacctaaatatattaatgtttgatctttgtattttctagtctcattaaaagtaagggcaaaaactacaattacttttgcaccaacctaatataaagcaaacattaatagaccaagggggaaatgaagacagcaatgaaataatagtagaaaactttaacaccccactttcaccaatggacagatcatccagacaaaatatcaacaaagaaacactggacttgaactgcactgtagaccaaatagagcaaacagacatttacggaacattccatccaacagctacacagttcacattcttctcaactgcacatggaacattctccaggagattatacattaggccacaaagcaagtcttaactaacttttttaaaatgaagtatttttttcctgccaataatggaataaaactataaatcaacaacaggaggaacaactgtacaaatacatggaaattaaagaacatgcccctaaacaaacaatgggtcaatgaagaaattaaaggagaagttaaaaaatttcttgaaacaaatgaaaatggaaacataacatgccaaaacttatgggatacagcaaaagtagtccttaaagaaaagtttatagcaataaatgcctacatcaaaaaaaaatctcaaataaacaacctaatgatgcatctcatggaactagaaaaacaagaacaaacaaaaccccaaattattagaagaaatgaatgaatacagatgagagcacaaataatcaaaatagaaactaaaaaatacaaaagatcagtataatgagttagttagttctttgaaaagataaaaaaaagtcaataaacttttagccagactaagtgataataaagaagaaaaacagaaataaatcagacatgaaaaaggagacattacaactgataacacagaaatacaaagaattataagaaactactatgaacaactataagccaacaaattgaaaagcctagaagaaatggataaattcctggacacatacaacctaccaaggttgaatcaagaaaaaatggaaattttgaacaaatcaacaatgagcaacaagattgaagcaaaaatacaaagtctcccatcaaagaaaagttcagtacccaatggcttcactgctgaattctaccaaacatctaaagaactaataccaattcttcacaaactattcaaaaaattgaaaaggaagaaactcttccaaaattattttaggaggataatgatcattatcctgatcccaaaaccagacaaaagcacaataacaacaaacaactacaggccaatatcctcaacaaaatactagaaatagaattcaacagcacattaaaagatcatttaccatgatcaggtgggatttatcccagtgatgtaaggatggtttaacatatgcaaattaagaatgaaggacaaaaattatattatcattttaatagacacagtaaaggcatttgacaaaattcaatatcccttcatgataaaaactctcaacaaagtatagaaggagcatacctatatgataaacctacaaacaagatgaaactgagtggggaaaagttgaaagcttttcctttaagaactggaataagacaagcatatccaccctcaccacttctattcaacacagtactggaagtcctagccagagcaattaggcaagacatccaaattggaaagaaggaagtcaaattgtccctgtttggccaggctcaatggcttatgcctgtaatcccagaactttgggaggccaaggcgggcagatcacttgatgtccagagttcgagaccagcctggcaatatggtgaaaccccatctctactaaaaatacacacacacacacacacacacacacatgctagccagacatggtggtgcgctcctgtagtcccagctactcgagaggctgaagcaggagaatcactagaaccccagaggcggagcttgtggtgagccaagatcgcaccactgcactgcagcctgggcaacagagtgaaacactgtctcgaaacaaaaacaaaaacaaacaaaacaaattgtccctgtttgcagaagacatgatcttatatatagaaaactgccaaaactacaccaaaaaactgttagagctagtaaatgaatgtagtaaacttgtagtctacaaaatcaacatacaataattgatagcatgtctatatgccaacagtgaacaatctgaaaaagcaatcaagaaagcaatcacgtttacaatagctacaaaaaatgtccagaaataaattaaccaaggaagtgaaagatctctataatgaaaactataaaatattgatgaaagaaattgaataagacacaaataaatggaaagatatttcatgttcatggattgaagaattaatattattaaagccaaagcaatctacagattcaatgcaattcctatcaaaattccaatgtcattcttcacagaaatagaaaaacaatcctaagatttgtgtggaaccacaaaaaatcccaaagagccaaagaagtcttgagcaaaaagaataaacctggaggcatcacactacctgatttcaaattatactacaaagttatagtaaccaaaacagcattgtgttgacataaaaacagacatatagaccaatagaacaaaatagagagcccagaaatacacccaaacatttaaagccaactgattttctacgaagttggcaagaatacatgatgggtaaagaacagtcttttcaataaatggtgctgggaaaactggatatccatatgcaaaagaatgaacctagaccccctatctctcaccacgtatgaaagtcaaataggccaggcacagtggctcatgcctgtaatcccagcactttgggaggccaaggcaggcagatcacttggggtcaggagtttgagaccggcctggccaacatggtgaaaccccgtctttactaaaaatacaaaattagccaggtgtggtggcacacctgtagtcccagcaacttgggaggctgaggcaggagaatcacttgaaccccagaggtggaggctgcagtgagcctagatcgtgctattgcactccagcctgggcaacagagtgagactctgtctcaaaaaaaaaaaaaaaaaaaaaaaaaagaaagacagaaagaaaagaaaagaacaatagattaaggaattaaatttaagacctgaaactctgaaattattagaagaaaacatagtgtaagcatttcatgacatcaatttgggcaagaatttgttagacaagacctcaaaatcatgagtaacaaaagcaaaaataaagaaattggattacatcaaactagaaagcttctgcacagcaaaggaaacaatcaacagagtgaagagacaacctatagaatgggagaaaatatttgcagattatacatctgacaagggattgatatctagaatatataaggaactcaaacaactcaatagcaaaagtccaaataatcctattaaaaatgaacaaaagacctgaatagacatttctccaaaagagacctacaaatggccaacaggtatatgaaaaatgctcaacatcactaaccatcaggaaaattaaaatcaaaactacaatgagatatcacttacccctgttagaatgactattataaaaaagacaaaataacaagtgctagcaaggatgtggagacaaagaaacccttatacactgttggtgggaatataaattagttaagccattagagataatggtatagagatgcctcaaaaattaaaaatagatctatcatattttctagcaatcccactactgggtatataccaaaaagaaatgaaatcagcatgttgaagaaacatctgcatccccatgtttatgacagcattattcacaatagtcaagatataaaatcaacttaaatgcccatcaatggatgaatggataaagaaactgtgatatagatacacaatggaatactattcatccatttaaaaaagatgaaatcctgtcattttcaacaacgtggatgagcctggaggacattatgttaagtgaaataagccaggcagagaaagacaaatactccatgatctcagtcctatgtacaatctttaaaatttgatctcatagtagttgagattagtgattctaggaagataagggggaagtgggagatggggagagattggtcaatgggtacaatgttacaggtagatagaaggaataagttctggtactctattgcacagtagggtgacaatagccaacaataatatattgtatatttcaaatagaagagaggattttgaatggtctcacaacaaagaaatgacaaacatttaaggtgatggatatgataattaccctgatttgaataattacacaatgtatacatgtattgaaacatcacattgtacccataaatttgtagaattatttatgtgtcaataaaaagtaatacagttaaaaaaataaaattgcccattaggataaataaaaagacccacacacaaaattatcattgtggcatttcagagcacagagagaagatacttaaagcttcttctgagaggaacaggacgcatacaaaagaatgggaattagactggcgatataattaagcaatattgtaaaagatctaagggaaaaattatttggaacctagaatttttagtcaaactatgaatcaattttgggggaagaaaaaagacattttcatatatagagggccttaatagtcactgaatgtgtactatagtaaaaccagaaactacataaaagaggaatttgggagattcagcaacccaagagaataatgaagtatgagggggatgttttctccttagttcttttccgtatttttcaataatttgataataaacatgcataattttataattaaaaaggaaattaattttgacaacatgcaagttcctgttctcacataccttatagtggagggacagattgtagtcaaataagcataataatacatgcaaaattacaaactgagcattactctgaaggaaaattacataattctatgtaagcctataatacaggaatctgacctagactggggaatcagagaaggcttccctaagcaagtaccccttgaacttagctttgaaactgggaaaatgaggcaatgtgagatgaagctgttagaggtattaggaatcaaacctattggggccttctagtccttagtagagagtctggactttattctatgtggaatgacagcctccagtgggttttaggctggcggatactacaatcagatctggaatgcagaaatagtacaccagtttctttgtgggtaaaagtcttagaggggagaatatgaccaactgtagggagacctgtaaaaaaagtttatcagtagctcagacgagataatggtaacttggattaagatagtggtagtagtaacagtgaaaaactagatacatttgaaagcttttagagccaaaataggaggcagctgtgcccttgttgttaccagtgtgggatctgaacacatgactacttgggttcaaatactgagcaaattaattaacctctctgggcatccgtttcctctcctgcaagacatggatgataatggtttctacattcatagggttgttatgaggaatgaatgaattaaaacttgtaaaatactttggacagtgcttgacataaaacaagtgctcaatacatattagctattattgattatattgccctggtcagtgtcaaactgcatatgggagatgagaatggtaacaaggataactctcacttgcatattcaaatgcaggatgctgccattcactgttataaaaaactctggaagagaatgaagtgatgaaaattgtaaatttggttttgaacatgtgggttttttgagatatctaggtggagatgttgagaaagtgattggctgtatgagcctggagttccagaagaggtcagcaggggagacagaagaaggagcagtctgagaagtaggagaaaaaaacccacagagatgttggcacagaggccaagggaagagagagttttaaaaacgaatgaatggtcaacaggtgcaaataaagactgaaaaatgtccattggatttagcagcatgatggtgattggtgaccttggcaagagctgttggtttgatagtagcccaatgttcttgataaatttgtttacaagtcaaggtagcaataaagtgtctaaagtcaatttgtccattctgtcctagcaagtgttttccatttcagattctctacttcatagccataggtgtcttattcctactttacaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatggtaatatcttggatctttaaaatgaatattataaatatccagtcctacttttaataaaatttactggacaatgtacaggaatatagtgtgttgctgaaggggacattatagagttactgtattagacctcagccaagatcccctagtttccagcttccagtgtaaagtttttaccttgactataaaagggcttgagtattagtaggactcatggatttttagttaaatgtctgtgatggagaaaagatggcttatggatgattgaggtgggaaaatgaggagaatagtatgcccttggtttctcagccttatcccattaattacgctccaatattatggagagaggaactgcaagttgtagctgaagagattttttttttttttggagaaatctagggaaatgggaaaaaaaggcattgtccagattgcaactgtaagggctccactatatcattagtaatgcccagagcagtaaatagcaaatatgacaggctattgtagagcttgacttcagacaccagacagccagaggcactctgtagatacctggcagtagatgagagacacctgtgaaactgagggcaggtcaggagctagtgaattttagaagtaacatgggattgaaaggactatttggtgggaactttggaaagggtcaaaggttctgtgtaagcaaattaggacgatggtaactacagttttaaattattgttaatgtaactttatttgtaactgctagttgtgcaaattcagattgcatcatcatttcaccccaattttccttacttttgtatttattctgctaactcttaatcttggatcaacctaataaccctctttctctacccctctcgtggccattgaaggctcttagtcagtttgtgctgcaataacagtataccacagaatgggtaatttataatggacagaaatttattggctcacatttctgggggctgggaggtccaatatcaagttgcctttttctgcgtcttaacatggtggaaggcattatatgacaaaagggcaaagaaagggtgagagagagcaagaggagggtgagctcactcctgtgataacaaatccactcccatgaacactttccccagataactgcattagtccattcatgagggtggaacgcttatgacctaaacaccttttatatgttcacctctcaataccatcacgatgataattaaatttcaatatgagtttcggaggggacagacattcaaaccatagcaagagttattggagaaaaatgtcggagaggcctaatcttttatatttaatagcatttctttcttcctattactctcatattaaccttctcctcaggttccttggttgacttagaaaagagaattgatcttgccatgcatccaccattttcctccttatgttctattagtgaccttgtttattgtcttctgtagtgattaagaatagaaatctctcttccccatgtgtcacataatatttatggaattttgacaagaccttagtggacaaaatgtgtcatactgaatgagtaacaggaagttgatgcacaaacaacattcttgcaggcacagaggaataggtcatttacttgtatatgatcattgtcaatcaatcattgtccagttggaccccgattcagtttattttttgttttgtttttctccttttcacagattctatccactaattttaatctttatttttcagaaaaaaatgctttatcttattgaacctcagaccaaacactttgtttttcgatgcagactgagttatgtttaaggctacatgaaccccagactagttgtttgctgctcctaaaaccttccctgttcctcataatcaagtaaacaggtctcccttcttagaagtatttgatcttcaaaattgccctgtggtataaatagggcaggaattattattatccattttacaaagcatgaagatgagactgagaatgttgaatacatttgccatagggtttacaactagtcacaggcagacatgctcttaaaatatatatctccttgattttaagttgtatcttgtcatggttttatgaacttggaacatgtcttaaagtttatatctacactaacatttttcccaataagctgttattaaatcaatgatttgtggcaagaagggatagtgatgtggaaagggggggtacttaggggagagcctggaaggcctaataagagagaaagaagtcataaaagttaaggcaagtgatatggtttggatatttatcttcactgaaatctcatgttgaattgtaatttccaatgctggaggtggggtctggtggcagatgtttggatcatgggggtgaatccctcatggcttgatgctgtcttcatgatatttggtcattcagaagtgtgtggcaacttgcactctctgtcttgctcctgctttcaccatgtgacatgtctcctcccccttcacctacccccatgattgtaagcttcctgagacctccctgaagccaagcagatgccagcaccatgcttcccatatagcctgcagaaacatgagccaattcaatctcttttctttataaattacctagtctctggtatagaacagcctaatatagcaagacactctgacattgtttggtttgtctgactccagatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacaggtaagcactttttgactattggtactctctcttccccatactcaaaaagttcttaccagttattcaaaccaacaaatcctgaagccatgtttaaggttaggtacaggtatggaatcaaatggcaagggtattaacatttggaaactaacatagctgagcatcagagaagcttgtatttttctcactccttgccttgattgaatcatataagctgttttagagttggatttgagcctacctagaatttttcttcccaacctctcatctttttttctcttatacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttggtaagttgaagaaaagatttaaggtcaggtaagaagaaaaagtctggagagttttgagtttctaaaatacctcataattcagccttgtctccaatggacatgatcttttaaaagctataaatgttacacaaataatagctgattgtatgtatttaaagtttgagtatatagaataaaaatttaatgtcacccactaaactcgacactcctttgaaatactgcttagactttgatacatatccttccagatctttctccattaattatgtcatataggagtcagcagactatggcctgtgaaccaaatttggcttgtggcctgcttttgaacagtccatgagcttagatgagattttacatttttaaaatattgcaaagaaaagaaaggaggatgggaggaaggggaggagaaggcggaggagcaagagaatatgtgacagaggctagatagggctcacaaattttagagtacttactatccagccttttccaaaaaatgcttgcttgctcctgatctaggatattaagaatgagtatggtgtaagtaacagaatactcaatggacagtggtttaaataaataagggtttattttcttcacaagaaatttgaagattggtcgttggttccataaattcagccgctgaagaatgtcatgaagaacactggtttttagatatggagttttgttagatactgccaaactgactttcagcaattttgtaccaatttatatcccctaccataagtatatgactgcccttttccccacaccattgccaacaacatatattataaaccttcagaaaattttccaatttgatgagcaaaatgtttatatgttgtcttcatttgcatttccctggttagtggtcaaattgtatattgtttcatgtttgttggctatttgtataactccctctgtgaattgcctgcttgtaaattttgtccagttttctatttggtcagtcatcttttgcttatgtatttgtaaaaggtctttatagattatggatattgacacattgttatttatctttcaaatgttttcctcacattgtcacttgtactttaactcctttatgatattttttgtccttcaaagatttttcatctttatatagtcaaaacctcctatcttttatcaatcttttcatttatatgtctctggatctttttcacttatgttttctgcctgagaatgtctttgccacccccaagacactacaaaaatagtctatattttattctcttacttgtatagctttatttttacagtgagcaatctaattgccctggaagttacttttgaatgtagtgcataattcaaatagaaattttcccaaatggcagctgacacaaccaatccttttttcattaatttgaaaatgtcttctttatcatatactaaattgctaaaatctgggatttttaattctccttaactaatctgttaccaccctgttttaatgacttcaactttgtgatatgtttgatatctgtatgacatcttctttcattgtacttcttcaaaatttttattagctattattgtacaatttttcttcataaattttgtgtacgtattttttctatttttcattttttgaagattgtataattttattttttattcattaatttttaaaatgcataatgacacaataattttacatatttatagggtactttttgtgtattttgagttacttttactggctaatttaaaaatagataaacaagagcatgcaataaaatgtaaattttcctccctcttggacttccaaccccatagtctgacagacagtcattgctgtgggtttgtatactcccctccagaagtagtgcatacatgtacaaatgtgtgtgtgtatgtgtgtgtgtgtgtgcatttcacacaaaaacaagagcagtgtaaattggtctgtaccttgatttttaaaaggtaacaatatattttgaattagccaggcatggtggcacatgcctgtagtcccagctactctggaggctgaggcaggagaatcgctcgaatctgggaggcggaggttgcagtgagctgagatcgcaccactgcactccaccctgggcaacagagtgagactctgtctcaaaaaaaaaaaaagtaacaatatattttggatatcatttcatgtcaacatatatagatctaccccattctttgatttattcaggttatactctggataccatgctgaatcctacacttaaacattacctcaaaatggatcaaagataaaatgtaagagctaaaactacaaaattataagaaaacaacaggataaatctttgtgatcttgaattagacaatagtttattggataggacaccaaaaccaacaagcaacaaaagaaaaaccatttgacccagccatcccattactaggtatatacccaaaggaatataaatcatgctgctataaagacacatgcacacgtatgtttattgcggcactactcacaatagcaaagacttggaaccaacccaaatatccaacaatgatagactgattaagaaaatgtggcacatatacaccatggaatactatgcagccataaaaaatgtccccgtttgcagatgacatgattgtatatctagaaaacaccattgtctcagcccaaaatctccttaagctgataagcaacttcagcaaagtctcaggatacaaaatcaatgtgcaaaaatcacaaacattcttatacaccaataacagacagagagccaaatcatgagtgaactcccattcacaattgcttcaaagagaataaaatacctaggaatccaacttacaagggatatgaaggacctcttcaaggagacctacaaaccactgctcaacgaaataaaagaggacacaaacaaatggaagaacattccatgctcatggataggaagaatgactgggttttaagacaagagcagaagtggaagttgcatttttatcctcatatcacacacctcagatctggaggtgggattgatattttcagggttcttcgctgcagcttccatgttattgctcttccattctctctctctctctctctctctctctcgtctctgtctctctctctctctcttgagatagggtctcattctgtcacccaggctggagtgctgtggtgtgatcacagctcactactgcagcctcaacttcctgggctgaagtgatcctcccacctcagcctcccaagtagctggtactataggcatgcaccaccacgcctagctaatttttttattttttgtagagatgaggtctcactgtgttacccaggctggtcttgaagtcctgggctcaaacgatcctcctgcctcagcctcccaaagtgctggcatgagccactgcacctaggcctttgttttcttttaaagctggtgcaatcaggcaataccacctgctacccttgcttaatactgtaatcaactgtcctcttggtcatgcctgctcatgcactgaagattttatctcctgaaacactgtctctttctctattatcagtgaatttaatgcccaaatagtaataaaggctgagaggaagcagtgtcctcaccaggcatctaaatttcaattagtgtgagaaggtgcagagaatacttcctgaagcaattgaaacaatttttaaagaagtggaaaggggcctttagagagaaacctaagtactgtcagccctctacattgtcaactgaagaatcctaagtttgtaaatttggagtggaaagggttgcaggctgggaagtgtagcctctggcagcaaatggaagcaagcactttgaagaaggaaggatgagataagaatttatgctgaatgagttggctaagtatacatatttaacaggttccaggaggagctgtgaatatttatgatggggcacctgcaaccacacatgttacatacattccatgttcactttggggtggagacttaacatttagatgcatgaaaattaggctgtatatgtcaaaagatgaaacagaggacacagaggcagcctctgtaaactggccagagccagtccatggtcagtggtctctcatcaggaagcaatgcttctcggttgttatgataaaactgcacaaagggaggggaatccaccacgtctttagaaaggactggtttatgtttaacccttaagaaagaaagtctaacggcagattagggagggagggaatgtaacaaggcatgcccgatctcccatcccatcatggtcagaaactcagtttttaagccatctctggggtctccttggccgagaaaggggtctcttcagtcgtttggggatgcttaagattttatttttatttttcagtatcactggatttctagtctcatattcaaacaaccattgattgaaagtattcaaaaaacaaccccaaaacaataaaagataataatacaacaataaacaataatacaaagaaacaatacggtaaaacaactatttacatagcatttatgttatattatgtactgtaagaaatctagagacgagttaaagtacatgagaggatgtgcatatgttatatgcaaatactacatcattttgagtaagagacttgagcatcacagattgtggtatctgcaggggtcctggaaccaatcctccatgcatgccaaggaacaatttcatgaaaagaccaaatattttgagttttatctagcctcaaattactataatgtagatagaggccacttttatttatctggagttagaccacagttttcttgttgatcctagtcgttttaggatttgatcttagatctcgcttatactttcagattatatttaagaatcaagcaagcagaccatataacatctaccctcacggaatcactgatgtccatcctttgtattcaaggagattaccaaaaggtaaatattccctcgatttatagctcttttttacctgtagatacagatgagataaatatcatcaataacaactaaaattatgttggtcctttctccagctgttggccggacctcaagctccagtctaaagttataaaaatcaattataggaatcctcaggtgatgtttcatgtaaattcgtgaagagtcgcctgacatgtttttcctattacctagcggtgatgttcaaatattccacagccaattagattccactgcaattggttccactgcaactactgtaaatgccctaaaatcttgaagctggttcttctggcacttaagataatttttttttctgagtacggttttcagctacattccacacttttggtatctagtgtggtattccacactttgggtaactagtttgatattttcaggattctttgctgcagcttccatgttattgctcttccttgctctctctctctctctctctcaacagggtttcactctcacttttggtatctagtttgatattttcagggttcttcgcatattcatttctaaatagttcacaactccagtttttatttactatattgtttgctgtttaaagatttattttttcttttagtagattggatgttatgtatattctttctattatttaattttggatgaatatttatcaaaataatagatgtgtatgcttaaaactacaaaagggctgcctccctagaggcatccatttttaagaatttctgtttttgatttttggtggttatctctacatctctaaaaagttacttatactgctaactctttgtttttcaactttagacattatatacttactttgttttgtgcttttttccattcaagttgtttcagttttatcagtgttttcagttggattggctatcattagaactttaaaaatatactaaacatcaacttttagtaagatattttccaatcatggattgaaaatatcttttgactccatacttcataaattaaggatattaaaaactgtacccctcacttttcctttccccaaacctttcttttctctactgctgctagccattcctttacttttacaaaactaaacttgataacatttacattttgtgctgtaatttgaaataactcttccttgctttgtctatatattttctctaaagcttaaaaaattaaaaaacagcatttgtattattttagtattttagcaagtttcttttcataaatgttaactgcagaactgggtaatatgctatgattgctctcttttctacagctcaagtgattttactattaagataaaataatatgtggaaggaaaaaagttgatctcatagaagtagagataaaatagtggttactagaggctaaagaggggaaggggagggggaaatagggagacgttggttaatggatgcaaaattccagctagataggaggcataagtcctaatgttctatagcactgtagggtgactgtagtcaacaatgacatctattttcaaatagctagatgagaggatttggaatgttcccaacacaaaggtgtatcctgaagtaagactttgttttcttttattcggaaaagaaatgtaggcttcttcaaccctatttcttaggcctttcagcttcttaatcattctatgtattgcttgctatccaaatcttttattttttttttgagacagcgtctcgctctgtcacccaggctggagtacagtggcacgatcttggctcactgcaacctctgcctcccaggctcaggctatcctcccacttcagcctcctgagtagttgggaccacagacgcacactaccatgcccagctaattttttttattatttttattttttgtagaaatggggtgttaacttgttgcccagactggtgtcgaactcctgagctcaagcgatctgcctgcctcagcctcccaaagtgctggaaccaaatctttttcttcttaaagacattcttgtagtgaatagcattaactacttttcccttgtacatttctattttttgatttcttcttttgtttttctggaagtatattctcaagtaacttctaaatatgtggtacatagagggtgaactttctgaatccttcagtatcacatgatgggcagacagactggttataaaaattttcccgctgggtgcggtggctcacgcctgtaatcccagcactttgggaggccgaggcgggcagatcacttgaggtcaggagttcaagaccagcttggccaacatggtgaaaacccatctctactaaaaatacaaaaaaaatagccgggcattgtggcgtgtgcctgtaatcccagctactcaggaggctgaggcaggagaattgcttgaaactgggaggtgaaggttgcagtgagccaagatcaccccactgcactccagcctgggcaacagagcaagactgcatctcaaaaaaaattccttcccctgttttctaatattcattattgccgataagaattctttatttgcatttctttatggaagaatggcatagtgacagagttctggggagattttgaatgtgtgtcccgaaatttggaggcatacgtggatagttactggtaacctgcttttccatggagaattttgaaggctgtaatgcccataatagtgggcaagaagagagggcaagagtggagcagtttaccttcctgctgtttgacatgagtttattctgtaacaagtgaatactgttgaaagtagctgggctttatcccttttgaagatattctacccaagaaggcagttaggcaggctgaggggatagcagaaccaatagagtcttggatatatcactggaagtaagaagagctgatggggagaggagagttgcagaaggatagctgaaagaaacatctctcatgtcatggaactatgtaatgctgaggtccccatggtaactctaaagaaaccatacatgtgtcctatgaaaagaccagcatttgggcacctcccacacagagaacattgatgaccaaatagtgttgtcaaagatagagcagcaggacctgttaaacaagagtctgtttgccctttcttctattacctaccctccctcacccccagctcctggaaaagggaagagaaggctcagaaatattgaaagaacatactacaccattccctttctttctttctttcttttttttttttttttggagacagagtctcgctctatcccccaggctggagtgcattggcatgatatcggctcaacctctgcctcccaggttcaagcaattctcatgcctcagcctcccaagtagctgggattacaagtgcctgccaccacacctggctaatttttgtatttttagtagagatggcgtttcaccatgttgaccaggctggtctcgaactcctcacctcaacaccattccctttctatggatcctctaaccataggtcaggcataacttactgaggtgaggaagagcttagaatgaatataaaattaaaattttgatttagattgtatcttcaggtatgaaacatacccagaatgagacttaattactaaaatcagttcttgtcctgaggacccattaccctgagggcagatctcagttcttgctccctttcctcacagaagtcagagactacaccttaaaactccaatgccaagctctttggcatatattcaggcctgacactttcacagtcaaccggataatcaattacagctttttactttttaaaaaaattgtttgaatcttaaaattataataggtgcgactttagcttccacttgctcagaaacttcatatgtacatacagatttgtagaacccttgcaacaacaacatgattatcaatatgtggcttgttgtactctaattgagctatttatggttttgcttgtgggtaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccaggtgagttcttgcctttccaagtgctgggtttcattctcagtgtatgtccccttataacctgaagaaaatataatggtttgcaatataggtcagtaaaagaaatgagcttagcttttactaaatttgagtttcacgtagtaaacgtgcctgctggatggataggccatagaatgtaggccctagatttttcctatagtactcattcccagtctgggatttagctctctctagctgatcctccccatttttatatgtccaattaccacctattttcagatgacccacagatttatatctacagcctagatttcttccatggacatctcattatgggtgactcaaaagtacctcaaaattaacatgtctgcagcatgtagcactgttgcaggaagtcagggaccccgaacagagggactggctgaagccacggcagaagaacataaattgtgaagatttcgtggacatttattagttccccaaattaatacttttataatttcttacgcctgtctttactgcgatctctgaacataaattgtgaagatttcatggacatttatcacttccccaaccaatactcttataatttcctatgcctgtctttactttaatctcttaatcctgtcatcttcataagctgaggatgtatgttgcctcaagaccctgtgatgattgcgttatctgcacaaattgtttgtaaagcttgtgtgtttgaacaatatgaaatctgggcaccttgaaaagaacaggataacagcgatttccagggaacaagggagataaccataaagtctgactgcctgcagggccaggcagaacagagtcatatttctcttcttgcaaaagcgaataggagaaatatcactgaattctttttctcagcaaggaacagccctgggaaaagaatgcattcccagggggaggcctctaaaatggccgctctgggagtgtttatcttatgcagttgaagataagggataaaatatgccctggtctcctgcagtgcccccaggcttgctaggattaggaaattccagcctggtgaattctagtcagaccagttctctgctcttgaaccctgtttcctgttaagatgtttatcaatgacaatgcatgcacagcaggacatggaacctcattagtaattctaatttcgccctaccttgtgatcttgctctgtccctatttgccttgtgatattttattgcctttgaatcatgtgatctttgtgacccacaccctattcgtacactccctcccctttgaaaatcactaataaaaacttgctggttttgcggcttgggggcatcacagaacctgccgacatgtgatgtcacccctggagacccagctgtaaaatttctctcttttgtactctttctctttatttcccagaccggccgacacttaggtaaaatagaaaagaacctatgttgaaatattgggggctagttcccacaatatagcacagtgcatctcacttagtaagagcttaataggctacgtgcggtggctcacgcctgtaatctcagcactttgggaggccgagacaggaggattgcttgagctcaggatttcaagaccatcctgggcaaaatagtaagaccttgtctacaaaaaaaaaaaaaaaaaaaaaaaattagctgggcatggtggtgtgtgcctgtagtcccacctactcaggaggctgaggtgggaagatagcttgagcccaggaggtcgaggctgcagtgagcctggatgacaaagcgacaccctgtctcaaaaaaaaaaaaaaaaaaaaaaaaaaaagcttaataaatacttttgggcaaaacatagggaaagatataaaatatttcaaaatatggctagaatttggaccatttctactgctttaaaaaataaagctaaattctctgaacaagaaaagcttagttcttcacaaaaactcattgctcggccccagaataactcagtgccatattgctgaggcttgactacatgtccatttgattatatttatgatacataagatccctactagtctgaaaacatttcatatgtttagagagtaaagtatatgaactttggtgccaataaaacacatggcacataaactcagagaagtataaattttgccaagtacttgtcctgaccgatttttcctaactatagttttttcgtcacttttgggaagagaactgaaatattattctatattctccaatctcctctcttcagtattttggtttatatagctataggttataaaaaatgaggtttatacatattagtgaggtttacatatgaaatcttagcagatccaattagcaagcgactaattcataaatctggttcatatacaaaatgctcttctgaaaaaaatttgaatgttttaaacagaaaatttaaggtattagtgttgtttgacatttttgtggttcaccttatctttcttatttgatttctgtttttctatttttaattttttatagccttgtggaaggtcagttgctagatggaagtttaggaaagtcagtatctcatttgacttaactaacttaagaaaggcactgaataaccacttggttctttaaggagttaaatcttctaatctgaacatgaagagaataaggctacagactgtaccaaataaatcagctagcatatggccttgggtgcagaaaaaactaagttcagtgggatcagtcaccctcttgtcctggggacacatttgttgtaagcatatactcactgctcatagcacccaccctcaactcccaagccctggtacatgcctaagaggaaatggaattaaaccaatggattagatatatcacatgcatgccatcgctttcatcatagactgctagctcctacctgacaacatcagtagcatttctttacccctttcaatatatgtaattaacagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagtgagtaaagcagcacttaagtccagtgggtggtgaataaagaaaaattgatgtaatcaaagtgatgtccagataatgaatgaattgtatgtgcacataaatttaacaattatgttacctataaatgtataatttttactcaaacacacgtgatcatataacccatattttaaaaatccagtcaccattttttcctttcaatatttacttgatttccctctcccttttaattccctatctccttctatattacatcttttcaccaaccattccatgcccaggtaacatattttaagacatattttctctataattatataatcatatataaacacatacatacattgtattagtcttctagtgctgccataacaaagtactgcagactgggtggcttaaccagcagatatctattgtcttacaactctggaggcttgagatcaggatgtgggcaacgttggtttcttctgaggcttctctccttgtcttgtagatggctttctcccttgtcttcacatggtttctcctttatatatctttgtcctaatctcctcttctaataaagataccagtattgttgggctagggcccaccgtaatgaccttattttaactaactacctatttaaaaacactatctccaggtatagtcacatgctgaggtactggggtttaggactgcaaggtataaatttgggatgggggaacacaattcagcccattgcatacatacacatgtgtatatatttatatataccacaaatctgaatggtcaaaaatatggtaaaaaattccaattgcactatcctacagggaaatgcgaaatagaataacaataggatagcactttatacccatcaaactgccaaaattataattactagtgggcttgtggataaaagagtgttctcatgctatattagtggataagtagtatagtcttttcaaaaccaatatatgccttttgaaattctgattattaagatgtttaagatggagtgagccacatttccctgtgtgtcccactggatgcaactaaaaatcctgaacaggccgggcacagtggctcacgcctgtaatcccagcactttgggaggccgaggcaggcggatcacgaggtcaggagatcgagaccatcctggctaacatagtgaaaccccgtctctactaaaaatacaaaaaattagccgggcatggtggcggccgcctgtagtcccagctactcaggaggctgaggcaggagaatggcgtgaacccggaaggcggagactgcagtgagccaagatcgtgccactgcactccaggccggcgacagagtgagactccgtttcaaaaaaaaaaaaaaaaaatcctgaacgaaatgcatgggaaccttgaaaagttataatgtgagttatactcacctaccagaatgtggcatatgttacaattctatgcccctcctctcaaagctttagccctttaactttgggttgagcctcatatttagcttgaatttctagtaatagtgatatattattctccagagttaaagtcctttactatccattattctaaaaattttaaggttgtttagtcctttgagttgcatttttattttttacatagttcagggtattgctttccttctgaaggattcagatttcacatttgtgcaagagtctaatgcttagtatttaattctagtggcacagagctttttcttttctccctcttctctccagcctcatggctttggtttagaattccttcagcctgatagaatattgtattttataatttccttattgtgctatttactagatatttgttcttctatttttttctattcataatttctccctttcccaccacatctttttccaagtaggatgtgcacttgccacagtatctggacagttaaactgtctcattttcttggagacggtgatgaaaactagagagatatagtgacataagcagagccagaaaacaatttcactgaagatgatatatattttttttcctctgggatttctaatatagcttttggtggagataagagtctggaattgagaaagaagagattggaattgagaaaaagagtctgagaaagcacagggagagacacaaaggcagagaccaagagacacaggggaaggatcttcagaggaagagtccagggagaaagatgctaagacagagggataagaaaagaagaaaaaaaaggaccaggaggagagagacccaaaccataaatcactcctatttccattagcagtaaaattgataatctattttcatacaatgaaataccatgtgacaatgaagattcacaaaaataaagctatacacaacaatatgaataagtatcacaaagacaatttttagtaaaatggtaagtgtcaaaagaatatatacagtattatattatttacataaagttcaaaaatgggcaaaattaacttatatagtttagggatacagaggaagaaaagtataaaggttagtaaggacatgattataataaaagacaagatagtggctacctcttagaaagagttcatttgagaataaacacatgtgttttgtggggatagcagcaatattgtatttcatgacctagatgtttgttttataattttgtgttttaaaaaattgtaggatttatgatttatttcgtagatggatcctacaaatgatagggaaattgcagtaggaatgaagaggaaggaacatgtacaggatttgtttagaagatagaaggcacatgattttgtaaataattagctatgtttggtaaaggactaagaggattcaaagatgattaccaaatttctgatatgggtaactagaagaagagtgagacaaaatggaagaaagtgtatttaaagaaatgatagcaaaaactttccaaatctggagaaagatgtaaatatccacgtacaagaagctcaaagatctctagtcagattagattcaaacaagactatatgaagacacgttacaatcaaactgtcaaatatcaaagacaaagagagaatcctgaaagcaacaacaaaaaagaagcaaaccacatacaaggaaattccaataaggcagaaactttacaggtcagaagagggtgggatgatatattccgagtactgggaaaactttacctagaaaatgtttccttcagaaatgcagagagataaagactttgccacacaattccagttagacaagagaaataaattaaagacatctattgtacactatggtgactacagttaataaattacccattccaatatatacatatataaacattgtgatgtacatcataatatattctatttttccctgtcaattaaaaaataaatttaaaaagattggatagagaagaatcagccattctagtaattaagcctgaggaagcttacattccagtgatttcagataaccattatgcaagttaaggaataaactggataggatgatattaaaaaaacaaaaccaccaatgagatacaccagaatggctaaaattaaaaaggctgtccataccaagtattggtaaagatgtagagtaatgagaactctcataaatttctggtcaggaaatccaaacatcgaaagccaaacatcggcataccctattgactcaggaaatccactcctagtatacacctgttatgtcctgaatcatgtcccctagaattaatatgctgaagccctaacactagtatttcagaatgtgactgtatttggagatagggtctttaaggggtttattaagttaaaatgaggttgttacaatgggccctaatccaatatgactagtgtccttataagaagaggaaatgtgggccaggcacagtggctcacgcctgtaatcccagcattttgggaggccaaggcgggcggatcacgaggtcaagagatcgagaccatcctggccaacatggtgaaaccccatctctactgaaaatacaaaaattagctggacatggtggcgagctcctgtagtcccagctactcgggagactgaggcagaagattgcttgaacccaggaggtggaggttgcagtgagcagagatcacgccactgcactccagactggcagacagaccgagactccatttgaaaaaaaaaaagaagaggaaatgtgtacacacagagacaccagggatgcatattcacagaggaaagaccaagccaaggagaggtgtcagtaaaaaccaaacctgccaataccttgatcttggaattttagtgttcaaaactgtgagaaaacacattcctgttatttacacctcccagtctgtggtatattgttatggcaaccctagccactagtacagcacccaaaagtagtgtgtacatatttcacaaaagacatgtaactatttaatccatgtggagtgtcaaaaggcaaaaatacaacaaatgtattttaaagattgtaattggcttttatacatgattctagaatcagatagccctcagaaccaaatacagaacagcagccagcaacatagtatggatagaaattggaagtgaggtttagagacagcttaattgattacagttgggcatttttgccttatttgaagctgttagtcgcctgcaattgatggaagttcagctgctataatcggctgagactgagctgtttgttataaaagcatattcctaaattaggctttcagttagttcatcaactaagccaggctgcaactttgttgtgcaaggactcaagtgcaaaggtacccttaggcaaaattcagattaatttaaaaggactttacttttgttagttatgtgaaatgaagtggaatctattttttccaagtggatagtcatattttctattatcatttaccaactagctgatttttttcctgtactggttggagatgctgcctttattatatattaagtttcaacttattatatattaagtttccgcttacatcttgtcagtttctggactccatattttgtttgatatatttatctattctgcattaagactgcatttttaattataatagctttataatatctcaatgttgtataggaaaaaaacttcaattattaattagttatactaagccaatgtctaagtattgcttagtggtttgtgggcaaccatcttacacagtacctagtaacagagtagacaagtgtttattgaatggatggatgaatggatgtgtggaagaggctttcagaaacaattcccttcatagactaaggccaatgttacttttgcttagctctttagtttgaaataatttaaaatgtacagaaaagttacaagaataatacatggaacttgcacacaccctttacccagattcacaaatgtttaacattttgcaattttgtttttcattttcttttctttatatacacacttctgttacttattttctatttgaaaattagttgcagacatcacatccctttacctctcaatactttagtacacatttcctgtgaataaagatatcttttacataacagacacttcaaattgataaagcacatttccataatttacaactggtattccagttgtatcaaccaatgctgtcatttatagcattttcttctttgaagtacagggatctagtacaagtaactacttgtcctgcttctttcatttccttgaatctggaccttcatcagatggtaactttaagcacccaaaggtttttttctggtttctcctctgtgtagtttaagaccatgcaaacatcttgctactcatcaaaatgccccccatataacatccaaattaatctttatcatgatggtttatgactgtctcctcacattgggattggggcccaactgattattaacaatctacttttttggaagatataatatctcttcctgggaataagataatgggcataacatataataattcctaattgtatcatgacaatcacaatccaaaatactaaatctgtgatgtgtctaaatctcttttccccattgtttttgcaggcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggttagttattatatttttcttgtaccaacagctgtgaatgcttcactagccattcgtatgctcttttgcccactagctcacatgctgtcatttatagcattttcttccttgaggtacagggatctagtttctcctctgagtagttattattttcacccttgcaactaataaacagtttgaaggatcacgtagtagttctatttttagttttttgaggaacctccttactcttttccacagtatttgtacttatttacactcccaccaacagtgtacaagcattccccttttgccacatcctcaccagcattttttaattattttgtctttttgataaaagccatttaactggagtgaaatatctcattgtgcttttggtttgcatttctctggtaattagtgatgttgagcagtttttcatatacttgttggccatttgtatgtcttctttttttttttttttttttttttttcagacggagtctcgctctgtagcccaggctggagtgcggtggcacgatctcggctcactgcaagctccgccacccgggttcacgccattctcctgcctcagcctcccgagtagctgggactacaggtgcccgccaccacacccagctaattttttgtatttttagtagagacagggtttcaccgtgttagccaggatggtctcgatttcctgacctcgtgatccacccgcctcggcctcccaaagtgctgggattacaggcgtgagccaccgtgcccagcctgaatgtcttcttttgagaaatgtctattcagatctttgtccatttttaatagggttctttgttttttttgctattgactagagtttcttatatattctggttattaatgccctctcagttgtatagtttgcaaatatttcatcccatcctataaattgtctcttcactttgttaattgtttcctttgctgtccagaagctttatggcttgatataatcccatttgtctacttttgctttagtcccctgtgcttttgaggtcttacctgcaaaatctttcccagaccaatgtcctggcgcattcccccaatgttttcttccagtagtttcatactttcaggttgtatattttagtctctaatccattttgatttgatttttgtatatagtgagagataggggtatagtttcattcttctgcatgtggatatccagttttcccacaccatttattgaagagactattctttcaccagtgcgtgttcttggcactttgtcaaaggtgagttggctataaatgtgtggatttatttctgggttttctgtcgtgttccactggcatatatttctggttttatgccagtaccgtgctgtttttgttactacagctttgtagtatagtttcaagtcaagtagtgtcatgcctccagctttgttcattttgctccagattatttagctgtttggagtcttttgtggttccacacaaattttaagattcttttttctatttctgtgaaaaacttcactggcatttggataggtattacattaaatctggtagcattgatattttaacaatattagtttttccagcccattaaaatgggatagataccttttcagttttttgtgtgttcttcaattccctttatcagtattttagttttcattatagagatatctcagctctttggtttaatttattccaatatatttatttttattatagctattgtaaatgatttttaaaaaatttctttttaggttgttagctcttggtatatagaaatgctactgatttttgcatgttggttttgtatcctgcaactttactgaatttgtttatcagttctaatagttttttgatggagtctttagttttttgtgaaatataagattatgtcatctataaacaaggagaatttgacttcttcctttccaatttgggtaccctttatttctttctcttgcttacttgttctggcttggacttccaggactacattttatagaattggtgaaagtgggcatccttatcttgtttcagatcttaaaggaaaggcttttggttttccacatttggtatgatattagccgtagtttgtcatatatggcatttattgttttgaggtaagctttctatacccagtttgtttagagttttctcatgaagggatgttgaatttaatctttttggcatcaattgaaatgatcatttgtttttgtccttcattctgttgatatgatgtatcacattgattcatttccatatgttgaaccatccttgcatccctgggatgaatcccccttgatcatgatgaatgatcttttactgtgttgttgaatttggtttgctagtagttcgttgaggatttttgcatcaatgttcatcagagatattggcctgtagtttctttttgtgtatgtgtgtgtctttgtctggtttggtttcagggtaatactggccttgtggaatcagtttggaagtatttttcccccttgatttttgggatagtttgtgaagagctggtattagttctttttttttattattatacattaagttttagggtacatgtgcacaatgtgcaggttagttacatatgtatacatgtgccatgctggtgtgctgtacccattaactcgtcatttagcattaggtatatcgcctaatgctatccctctccccttcccccaccccacaacagtccccagagtgtgatgttccccttcctgtgtccatgtgttctcattgttcaattcccacctatgagtgagaatatgcagtgtttggttttttgttcttgcgatcgtttactgagaatgatgatttccaatttcatccatgtccctacaaaggacatgaactcatcatttttatggcggcatagtattccatggtgtatatgtgccacattttcttactccagtctatcattgttggacatttgggttggttccaagtctttgctattgtgaatactgccgctataaacatacgtgtgcatgtgtctctatagcagcatgatttatagtcctttgggtatatacccagtaatgggatggctgggtcaaatggtatttctagttctagatccctgaggaatcgccacactgacttccacaatggttgaactagtttacagtcccaccaacattgtaaaagtgttcctatttctccacatcctctccagcacctgttgtttcctgactttttaatgatcgccattctaactggtgtgagatggtatctcactgtggttttgatttgcatttctctgatggccagtgatggtgagcattttttcatgtgttttttggctgcataaatgtcttcttttgtgaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagttcccatttgtcaattttggcttttgttgccattgcttttggtgttttagacatgaagtccttgcacatgcctatgtcctgaatggtattgcctaggttttcttctagggtttttatggttttaggtctaacgtttaagtctttaatccatcttgaattaattttagtataaggtgtaaggaagggttccagtttcagctttctacatatggctagccagttttcccagcaccatttattaaatagggaatcctttccccactgcttatttttctcaggcttgtcaaagatcaggtagttgtagatgcgtggcgttatttctgagggctctgttctgttccattggtctatatctctgttttggtaccagtaccatgctgttttggttactgtagccttgtagcatagtttgaagtcagggagcgtgatgcctccagctttgttcattaggcttaggattgacttggcgatgcgggctcttttttggtttcatatgaactttaaagtagttttttccaattctgtgaagaaagtcattggtagcttgatggggatggcattgaatctataaattacattgggcagtatggccattttcatgatattgattcttcctacccatgagcatggaatagtcttccatttgtttgtatcctcttttatttccttgagcagtggtttgtagttctccttgaagaggtccttcacatccgttgtaagttgtattcctaggtattttattctctttgaagcaattgtgaatgggagttcgcttatgatttggctctctgtttgcctgttattggtgtataagaatgcttgtgatttttgtacattgattttgtatcctgaggctttgctgaagttgcttatcagcttaaggagattttgggctgagacaatggggttttctagatatacaatcctgacatctgcaaacagggacaatttgacttcctcttttcctaattgaatacactttatttccttctcctgcctaattgccctggccagaacttccaacactatgttgaataggaaaggtgagagaaggcatccctgtcttgtgccagttttcaaagggaatgcttccagtttttgcccattcagtatgatattggctgtgggtttgccatagatagctcttattattttgagatacgtcccatcaataccaaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttttgtctctgcccggctttggtatcaggatgatgctggcctcataaaatgagttcaggaggattccctctttttctattgattggaatagtttcagaaggaatggtaccaattcctccttctacctctggtagaatttggctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctcttttcttctttattagtcttgctagcggtctatcaattctgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccatctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttgttttacatttgctgaggagagctttacttccaactatgtggtcaattttggaataggtgtggtgtggtgctgaaaaaaatgtatattctgttgatttggggtggagagttctgtggatgtctattaggtccgcttggtgcagagctgagttcaattcctgagtatccttgttaactttctgtctcgttgatctgtctaatgttgacagtggggtgttaaagtctcccattattattgtgtgggagtctaagtctctttgtaggtcactcaggacttgctttatgaaactgggtgctcctgtattgggtgcatatatatttaggatagttagctcttcttgttgaattgatccctttaccattatgtaatggccttctttgtctcttttgatctttgttggtttaaagtctgttctatcagagactaggattgcaacccctgcctttttttgttttccacttgcttggtagatcttcctccatccttttattttgaggctatgtgtgtttctgcacgtgagatgggtttcctgaatacagcacactgatgggtcttgactctttatccaatttgccagtctgtgtcttttaattggagcatttagtccatttacatttaaagttaatattgttatgtgtgaatttgatcttgtcattttgatgttagctggttattttgctcgttagttgattcagtttcttcctagcattgatggtctttacaatttggcatgattttgcagtggctggtactggttgctcctttccatgtttagtgcttccttcagaagctctcttaggtcaggcctggtggtgacaaaatctctcagcatttgcttgtctgtaaaggattttatttctccttcacttatgaagcttagtttggctggatatgaaattctgggttgaaaattcttttctttaagaatgttgaatgttggcccccactctcttctggcttgtagagtttctgccgaaagatcagctgttagtctgatgggcttccctttgtgggtaacccgacctttctgtctggctgtccttaacattttttccttcatttcaactttggtgaatctgacaattatatgtcttggagttgctcttctcaaggagtatctttgtggcattctctgtatttcctgaatttgaatgttggcctgccttgctagatttggcaagttctcttggataataccctgcagagtgttttccaacttggttccattctccccatcactttcaggtacaccaatcagttgtagatttggtcttttcacatagtcccgtatttcttggaggcttcgtttgtttctttttattcttttttctctaaacttatcttcacacttcattttattcatttcatcttccattgctgataccctttcttccagttgatcgcattggttactgaggcttgtgcattcatcacatagttctcgtgccgtggttttcagctccatcaggtcctttaaccacttctctgcattggttattctagttgtccattcgtctaattttttttcaaagtttataacttctttgccattggttcgaacttcttcctttagctcggagtagtttgatcttctgaagccttcctctctcaactcatcaaagtcattctccatccagctttgttccattgctggtgaggagctgcattcctttggaggaggggaggtgctctgattcttagagtttttggtttttctgctctgttttttccccatctttgtggttttatctacctttggtctttgatgatggtgacgtacagatgggttttcggtgtggatgtcctttctgtttgttagttttccttctaacagtcaggaccctcagctgcaggtctgttggagtttgctggaggtccactccagaccctgtttgcctgggtatcagcagcagaggctgcagaacagcagatattggtgaactgcaaatgctgctgcctgatcattcctctggaagttttgtctcagaggagtagctggccatgtgaggtgtcagtctgcccctactggggggtgcctcccagttaggctactcaggattcagggacccacttgaggaggcagtctgcccgttctcagatctcaagctgcgtgctgggagaaccactactctcttcaaagctgtcagacagggacatttaagtctgcagaggttattgctgtcttttgtttgtctgtgccctgcccgcagaggtggagcctacagaggcaggcaggcctccttgagctgtggggggctccacccagttcgagcttcccggccgctttgtttacctactcaagcctgagcaatggcgggcacccatcccccagccttgctgccaccttgcagtttgatctcagactgctgtgctagcaatgagcaaggctccatgggcgtaggaccctctgagccaggtgcaggatataatctcctggtgtgccgtttgttaagcccgttggaagagcgcagtattagggtgggagtgacccgattttccaggtgccatctgtcacccctttctttgactaggaaagggaattccctgaccccttgtgcttcctgggtgaggcgatgcctcgccctgcttcggctcacgcacagtgcactgcacccactgtcctgcacccactgtccggcactccccagtaagatgaacccggtacctcagttggaaatgcagaaatcacccgtcttctgcatcacttatgctgggagctgtagactggagctgttcctattcggccatcttggctcccaatgcaaagaccttcaaacaacgtgacttcattttctcactcctaccttttgtgctcttgtcatttatttgaattctacatatattttaaaccccataagacattattattgttttatataatcaatatcatttatatatatatatatatttacacctttcatttctttcattcttttctgcatttcttgcttccatctatgatcattttctttttgtctgaagaaacttctttggaacttccttcagtgtgtgttggctagtaaaaagttctctgtcagtttttggtcagaatgggtctttattttgcctagatacaagtccttggttggatttacatattgtgaatgttttctcccagtctgtggtttgtcttttcactcctttaagggtgcattatggttaatagaagttcttacatttaattaattcttatttttcagttttttatggttaatgccttttgtattctgtttcagaaatttttgcctatcctaagaacatgatgccatccttctatattttctttctacatattttaaatattttcttctagaagtctgattgctgtgttgttcacaattaagtttatgattcatttttaattaattttgatggagtgatgcagataaaagttcatttttccatatggatatttaattgctctagcaccaattgttggaaaaaaataatttcctcactgaattgcactgttgtctttgccatgaatctgatgactgtatcactgtagctttgtttctgtactctatttcaggggtaggttatgatccacaagccaaatttgcagcttgtttttatatggcattgagctaagaatttttttacatttttaaagaattgtcacacaaaacaaaaaaaaagcaaaaaaacaaataaggatatgtatcatggaccatatgtgtctacaaacctaaaatatttactatgttgctttttacagaaaaagtttgccaacccctgatctcttatattccattgacttattggtctatctttgtaccagtaacatactatcttatagtaagttttaatatttgttagtataattcctccaactttgctctctttgatttttatataaattttagaatcatcttgtcaattttatcaataaaaatatcttctgaggttttgatagggattacattgattctgcagatcaatttgggggagcatacctcttgacaatattgagtattcctgtccatgagcatggtttagttatttatttacatcttttaaattttctcttggcaatgtttttgtaaaattttagtgtacaggtcttgcacatttttgtaaagtgtattctttggtatttaatgctattataatattttttatggtatcagtttttgtcaattgtgtttttctagaaatatgtccctttcatctaagttgtttaatttacttgaagtaagttatttgtaatgttcttttatcatccttataatgtctgtactgatgtctccgttttcatacctgatattgttatttatattttatctattttaagtttatcgcctgcacccactaactcgtcatctagcattaggtatatctcccaatgatatccctcgcccctccccctagtgcacatgtaccctaaaacttaaagtataataaaaaaaaaaagtttgtcgcctttgttataggttcatcaaatttactaatcctaccataggatcaaatttttgctttgttcatcaggtcatggaattaaaaaaatttttttgttttgtttattttctatgttgaatttttatttttattttgctttgcatttcatttatttctggtcttttgttattattccaatactttctctggattcagttttctttttcttcttgacttcttgagattaaaacttggttcattgattttcaacatttcttactttttaaaagttcatacaaagcataaatttccctttatatactgctttaaccccatatcacaaattttgatgagtcatatttttattatcattgagtttaaaatattttataaattttacgttatttcttgttttattcatagttattttacagtgttttacttaatttcccaatatatggcgattttctggctctctctctgttgctgatttatttgttttactgtgatcacataacatactctatattatttcaatcatttgaaatttgttgagacttgctatatgcccagtgaataatttaatttgattaatggcccactgcatttgaaacaaatatgtctttgctgttattgggtagagtgtcatatatttgcctattatgtcaagttgctttatcatgtttttaaaatccttataaacttcctgatattttatctgtttcttacagacatggaggaaactgtgacatctctgtgattgttgagtttgttattttgatttttgtatttgttagtaagaatgtttcaaaataaatgaggcaatataaaatcaggtgcttacaactttaaggttgtattcttattaaatcaattctttcatctttgtgaaatgtcctttttgtctgaagtagtacttgttgccttaaacgtctgcattgtctaaaatttatacacctgcactatcatatttattttgcttaatgtttgtgtggtatatatttcccattcttttcttttcaacctatctctatccttatatttacagtgtgtcttttttaacattttctgtagtgcaagtctgttggttaattaattttgtcagtttttgcttctctgaaaagtctttatttctgtttttgaattatatcttcactgtgtatagaattctgggtttgtggttgttgtttttgttttattacattttgttttattggtttttccctcagcactttaaaaatgccgctccattgtttctacttgcatagtttttcacaataagtttgttgtaattcccatttgcattcaactgtacataatgtatctttttaaaaaaatctggatggcttcaagctctttactttgatttttgtgtgtgtgtgtgtgtgtgtgtgtgtgtgtgtgtgtgtgtgttactttggcattctctaggcttattcaatctgtaatttggtatcattaattttgaaaaatatttatcatctgtgtcttcaaatattgcttctaattctttctcttcttctggtattgcatttacatatattatactgttcaattttgtcacacagctcttgaatatgctgttctagtttgttttctaactatttttccttctagttgttcagttttgttgacatttattgacctatttttacttcagtaattgtttcctgggttgttgagttaattgatgaactcatagatgacatacaatttatctttttattcttgtgtcacttgtgcttttgatgtcacatctaggaaggctttgtctagcccaaggccacatttacttccatattttcttctaagagtttgatagttgtagctgttacatatatgtctatgatctagtttgaataaatttttgtgtatggtgtgaagaagaggtctaacctcttttttattttttgcatgtaaacatccagttgtcccggcaccatttgttgaaaatatgattcttttcccattaagtcatcttgacacccttgttgaaaatcaattgaccataaatgtgagagtttatttctgaactctccattctgttccattgacccatacgtcttctataaattcttatagctaattctacattagactttggtttttcagatgtggtcatctcattagattatggtgatatgtttggttacaagttttatcttctccttggcaacattttttttattactgctcttcttttattcgtttttgttgttcctttctctttttgtgagacagggtctcactctgttgcccagggtggagtaagtggtgtgatcatggctcactgcagcctcaacctcctgggctcaagcaatcctcccacctcagcctcccaagtagtgggactacaggcatgcaccatcatgccaggctaacttttttattttttgtagagacagggtcttgctttgttgcccaggctggtcttgaactccaagctcaagcaatcctccaacctcagcttcccaaagtgctgggattaccagtatgagccactgcacctggccttgttgttcctttcttccttttatcttgtagtatcttgatcctttttgcttattatttatcattgaggtgagtttgttctaaataaacttttcgcagaaagtttatgtagatatattaatatcaatgaggcattaggagtgagttttagattagcaggaattctcttatgaaaggtattgattgtatgtgtgagttttcagcctttacttctctccagcccatcaagatcaaagctgcagagttgtttacatttcagaatttctttcctcccctccccaccttgcaaaacagacttacagtgcaaaaatgacttgtcaatgtgattctttcttctggtcccatctttcctaccttttgagacttgtgttgaaaggagtccagtaaaaccaccgatgctagcttgtataccctgatcccattgttataatgaatgactgactgtttttcatatcaaagtataatacttgcaccttgatagaagaaagaaacaaggccaggcacagtggttcatgcctgtaatcccagcactttgggaggctgaagtaggaggaataattagactttgatattaaaaatggggaagatatggcggtataagatatgaggaagtatgtcttcttggacttttctgaaatctgccagccatgagcatccactctttttatcttttgatacctgttttatattaactatacttctattttgtggtttcatggcttcagatatcttccagcttaattgtactctgtctttaattatttgcagcaatttctgaaaggagcaagaagaaaggccagccctttcttcactaccttaaaaactggtcatcttttgaaaccccatgaaaggcacagtgggtgaccatctacatcaggagtgggcaaactatggcccttgggtagtctggtctctgtccgtttttgtaaggttttattggaacccatacacacacaaactgatcatctcttgttatgtgttaagttttcttataattattcttttctatttcatccagctgaattaccatttcaccttgtgtatgccctttccagtcttaaattatagaagctatgtctttgtggttttaaattatggaagctgtgccttcttgtgttttagtatggcaagatatttgttcttacttttcctctagaatctgcagtggattactttcagaagtaggtattgcctctaagtttcctgacttctgtttccttctccctgttctgtagtatatttatagattgcatgttttctcgtccttaaacaaggtacaaatatgttctgatcaaggtttgctagccgagaggataagtggcttgctcttagcctaactctctgtctacttaatggatgtcgaattcccttctcaactcaacagctagtaactagttccaagatcggataatagcttacagaattaattagttcagtgaaagccctggtttgatcacagaggcaggagactgatctatatatttgtagtgctgactagaccccaacttggccagatagcttatacctatgtcagaagttggaggaggagattgacagctgaggtgtctccaagggaattacaattattttcattttctttgtgtctgtaattatgtctcttttcttacttcaaattttgtatatgtgaaatttcttaatttttatttggttatttattttattgactttttcatcaaacaaccaactctaagttcttggattgaaatttatgaattaattataatgttttaaatttaccattagtcacacatacaatacaaaaagatattttcattacaaaattttaacccaagccattaaaactaaactccagcttggtcaccattcctaataccaggcccctctcagaggggagggtaaataaaagtccattttggtaactagtttgacgagaatctctaattgtttccctgtttttcttataatgtctgcctttgaattatcctctttttttcaagagttccatcatataatgtattcctttttgcttacagattgacctcctagaggcatgcatccccctgctccagtctgagctggttctctctaggcctgaggctcagttatcaacttgggacttttatttaccctccctcaggataggtacctggttcttggataccaggtcttactcttgtttgagatactcctttattttggtggcaaacattccataatcacttcctgataatggtgacatttgaggtagattttctgagtctttatatgttagaatatgtttttattctcctttgccacttgattgataatttggctgcacatagaatgtaagcattcacagggcttttgggagcagcttcccttgagaagaaggtggatgcagttaagatcttccctgaaaagactgtgtgaaatgacaaggctattgaggtacccaacgggtagcttggtaaaggtgtatcttgtctcttatgtttatgcatctactttaccaccatgtaattagcctattataacttgttgcattccttcactcagctaatcttgttcatggtagaaattaatattgctagtaccatggtagaattttatattagctggatcctagacctaaatgctccttccttgtgcttacatattctgcaagtgggtgacagtggatgctaggtattgtgttatgtgatttcaatgtattatatgatggggtagatactattagcctcatttgaaaattagaaacctattgttcagaaagtttaagtgactttctcaaagtcacacagctggtaaatggtagaactgggatttgaatccaggcaatctgatggatttaagaggaacctgtgccactatgtgatatagcaataacatctagccaatataaatactttcctgaattaaatcactgtcatattcagagagttctgtgtcactattaagaccctccattattgtgtatattaattacatttccctattttaatcccaatatctattcatttttatcacagtcctttcttatggtcacaaacaggcatagtacaacagcagcaatgcaaaaaccacttttatattacatgttccagggatttaacccaatgacctgtgatataatgatactgactagtattttttcatttatctgggaatgggagagaacctctaacagaacgttttagaatctgtgttatgagtaaccagagtcttattcttcctcatctccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgagggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacaggtatgaatgcattggttattcctttgctctgctcttgtgacatttgactttaccagatgatgacaccaacaatgagagttagaggatgaaaaatcaaggtgtcttgaaactcttactctggtgagatagagagaagagaggtttacaagagggtagaggaatcagggacaagaaggagcaatggggagcaggaagaaagtcaacctcacctatcaaccttatgagctgcaggggaaatcttagtctcatcagagaactttaagcaaggcagaaggaagaagcaagttcgtgttaaagaggttaaggacttggggaggattggttttcatgatactggggatccagagggcaaagtaggatgattttatttttaggtgagtagagggaggttgagcagtcaagtagtacagagaaatgtggaatataaacataaggagagtcagtcagtcacaaatatttatggaacacctactacatgccagacacttttgtacacattggagtgcagcacagcaggagcttatattctattggaaagagcaagagacaagttagtacaaaactaaataaggcaatctcaattgtgttgttcagaagatagaatagaataatatggtagagagaataatatgatagagtaatacggtagagtgttacattagctgtggtggtcatagaaatcatctttgaggagttgagacctaaatgatgataacaggccagctgatggagctctgagagaagatgtttccagacagagggaagagaaaatgcaaaggccctgagaatggaaaaagtttaccatgtttgaggaacaagaagggacaagcatgacttgtcactttcccaccttgctttctagctcaagtaagcccttattgctgcattgcaaccatagactatttccctagtccactgactttctcattctcctggacctctatcttagattttctgtgttttccttaaatctcgagcaccttttttccattctccaatgcccattttcactcttagctgatgctgtgcaatgaacctccacagactcccaacatcacatttactggcatttgtacccatatactctgcctgcacacttattacaataaatagagtgtctgtgctcctaaggccaacctctccagttttgtacttgattcccatctcttctcccttcataaaaaatgttgctccagcaatttctccttttctcccttacatcatcaatttatctctccactagattaatctcatcaacatcaatcatgctattatttcctcccctatctttacagaaaccgtcttaaaataattgtccctgcttgcagcctttgcatcttttcctgccattctctcctctttaacccactccaaagaagcttttatctctattatttcataagaactacattttcaaggtcattattgatctttacattactgattactagccctcatcttatttgaattctcagtagtatttgagaggtgattactccatcgttgatacaggttctcacttggtttctctaacaccacttttcttcacttttctactaaacttactgccaatctttgtcaactttgcgagtccttcttcatccccctaatctttaaaggttagagtgctccagggattagttctccaacttcttctttattctatttatactcactctgtgacgacattgtttagcctcatgattttaagtactatctatctgcagataattccagttgaatatctggagatattctcagatctctctcctgaagtcaaaatttacatatcaactccctaccttaacatgcacacaattagactcttaattcctgccccttcccaaaacctgctgattgctcagccttctccatggcaatcaaaaaccattcctggccgggcatggtggctcactcctgtaaccccagcacttggggaagctgaggcaggtggattggttgagccccagagttcaagatcagcctgggcaacatggcaaaacctcatctctattaaaaatacaaaaattagccaggcgtggtggtgcacacctgcagtcccagctactcaggaggctgaggcacgagaatcgcttgaactggggagacggaggttgcagtgagctgagatggcctcactgcactccagcctgggcaacagagtcagacttgatctcaaaaaaataaataagtaaaaccattccctatttcagttattcagtcacagatcttgaagttttccaactctttttttcttacattaacatctaatctgtaaaggatcctgtattagtccattttcacactgctaataaagacatacctgagactgggcaatttacaaaagaaagaagtttaatggactcacagttccacatggctggggaggcctcacaatcatggcagaaggcagggaggagcaagttatatctcacatggatggcacaggcaaagagagagagcttgtgcagggaaactcctctttttaaaaccatcagatcttgtgagacttattcactatcatgagaacagcaagggaaggacctactgccatgattcagttacctcctatcaggtccctcccacagaacatgggaattcaagatgagatttgggtagggacacagccaaaccatatcattccaccccatcccctcccaaatctcgtgtcctcacatttcaaaaccaatcatgccttcccaacagtcccccaaagtcataacacatttcagcattaactcaaaagtccacagtccaatgtctcatctaagacaaggcaagtcccttccacctatgagcatgtaaagtcaaaagcaagttagttacttcctagatacaatggggtataggcattgggtaaatacagccattccaaatgggagaaattggccaaaacaaagggcctacaggccccatgcaagtctgaaattctacggggcagtcaaatcttaaatctctaaagtgatctcctttgactccatgtcttgcatctgagtcatgctgatgcaagaggtgggtgcccatggtcttgggcagctccacccctgtggctttgcagggtacagcctcccttgtgtctgccttcatgggctggcattttctgtagcttttccagatgctggtgcaagtttctgatggatctaccattccggggtctggaggacggtggccctcttctcacagctccactaggtggtaccccagtagggactctgtgtgggtgccctgagcccacatttcccttctgcactgccctagcagagtttctacatgaaggcccacccccgcagcaaacttctgcctgggcatccaggcacttccattaatttctaaacaacaaagcattcaagaggcgacttgggtgctattaagggcattcagtttcataagggaagcagagcataaaagtttggaaaatttgcagcctgataatgttagagaaaagcaaatcccattttctgaggagaaattcaagcaggctgcagaaatttgcataagtaatgaggagccgaatgttaatccccaagacaatggggaaaatgtctccagggcatgtcagaggtcttcacaccagcccctcccatcaccggcccagaggcctaagaggaaaaagttgtttcatgggctgggcccaggatccccatgctgtgtgcagcctagggagtcggtgccttgtgtcccagccgctacagccatggctgaaaggggtcaatgtagagctcaggctgtggcttcatagggtacaagtcccaagccttggcagcttccacatgatgttgagcctgcgagtgcacagaagtcaagaactggggtttgggaacttccgcctagatttcagaagatgtatgaaaacacctggatgcctaggcagaagtttgctgcgggggtgggccctcatggagaacctctgctagggcagtgcagaagggaaatgtgggctcagagcacacacacagagtccctgctggggtaccacctagtggagctgtgagaagaggaccaccgtcctccaggccccagaatggtagataccctaaatcatctctttcaaattcgaagttccacaaatctctaggacaggagcaaaatgccaccagtatctttgctaaaacataacaagagttacctttgctccagttcccaacaagttcctcatctctatctgagaccacctcagcctggatttcattgtccatatcattatcagccttttggtcaaagccattcaacaagtctctagagagttccaaactttccacattttcctgtcgtcttctgagccctccaaactgttccaacctctgcctgttacccagttccaaagtcgcttccacatttttgggtatcttttcagcagcaccccactctactggtaccaacttactgtattagtctgttctcacactgctgataaagatatacctgagactgggaaatttacaaaggaaagaggttttatggacttactgttccacatggctggggaggcctcaaaatcatggcagaaggcaaggaggagcaagtcttgtcttacatggatggcagcaggcaaagaaagaaagcttgtgcaggaaaactcttttttttcttttcttctttttagacagagtcttgctctgtcacgcaggctggagtcagtggcgtgatcttggctcactgcaacctccacctcccgggttcaagtgattctcctgcctcagccttccaagtagctggtactacaggcatgtgccaccacatgagatgagattttggtagggacacagccaaaccatatcattccccctgtcccctcccaaatctcatgtcctcacatttcaaaaccaatcatgccttcccaacagtcccccaaagtcataactcatttcagcattaactcaaaagtccacagtatttttagtagagatggggtttcaccatattggccagactggtctctaactcctgaccttatgatccgcccgccttggcctcccaaagcactgggattacaggtgtgagccaccatgcccagccaaaaactcttctttttaaaaccatcagttctcatgagacttattcactatcacaagaacagcataggaaagatctgcccccatgattcaattacctcccaccaggtccctcccacaacacatgggaattcacgatgagatttgggtggggatcctcttggctatcatttcaaaaaatagtcagggttgattatggacttagtattgaataagatgaaaatgtactgaaatggaacgatgaagataattgaccagggaaagcaggttacaagccaagagaggatacagtgtcacttcagatgctataaaagtgatgtttttattttttgaatgttatttggctatattttcaaattatctgcactgcatatgcactgcttctgtaataataaaagggtattaaaataataaaatcaagtctataaatcacacacacacaccccagcctcttctctacacctcagtgactaccaaccacatctaaattatcatcatttctcatctgaattattgcaagaagccattgcaataattcagatgagagttgatacaaagccttcctgtttccaaccttaccctcatatagtcttttcccaacattgcatctaaagtaatttttcaaattgcaattctgatcactgttctctgcttcagatcctccagtggattttcatctcactcagtaaattccaaagccttcaccatggccttcaagaccctacgaaatttgaccctctgcaacctctctgccttcatctgttaccattgtctcctgttaatcctgcctcagccacactgacctccttgttcttctcaaatggactagatgtgtgcctatctctagaccattacagtttctgttctctctacttaaaattatgtccctgatactctaatgcaagttctcttacttccttcaggacgctgctcaaatttcattttatcagtgaggctttccctgaacactgtatgtaaatattgctcccaccattttttttcaatgcacttaacagtgcctgaaatattatatatttatttctttattgtctatcttctctgactataagttaagctcattaagaacacaaactttggaggtattgttcaatgttgtgtccccagaactttgaacagtgcctggcacgtggcagatgttcaaataaatgtatgttgaatgaattagaaaatgataaatgtagggagacaaaagcaggtctcccatttatatccaaactctaggactctaggaaagactgattatatggaatcgtgtcacacagcatccatgggcaagagtggaggcagagataccagttaagatgctattgcagtcatacagataaaagaagacagttatttagaccagtgtggtggtgacagaaatggaaagaaatggaaggatgttgggtataattaaagataagcatataagactggctgttaattgagtatgggaagaatgaggagagaggatgtaaagaacatttctttttgtttgtttgttttgttttgtttttgtttctttttattatactttaagttctagggtacgtgtgcacaacctgcaggtttgttacatatgtatacatgtgccatgttggtgtgctgcgcccattaactcatcatttacattaggtatatctcctaatgctatccctccctcttccccccaccccccaacaggccccggtgtgtgatgttcccctacctgtgtccaagtgttctcattgttcaattcccacctatgagtgagaacatacagtgtttggttttttgtccttgcgatagtttgctgagaatgatggtttccagcttcatccatgtccctacaaaggacatgaactcatccttttttagggctgcatagtattccatggtgtatatgtgccacattttcttaatccagtctatcattgatggacatttgggttggttccaagtctttgctattgtgaatagtgccgcaataaatatacgtgtgcatgtgtctttatagcagcatgatttatagtcctttgggtatatacccagtaatgggatggctgggtcaaatggcatttctagttctagatccctgaggaattgccacactgacttccacaatggttgaactagtttacagtcccaccaacagtgtaaaagtgttcctatttctccacatcctctccagcacgtgttgtttcctgactttttaatgatcgccattctaactggtgtgagatggtatctcactgtggttttgatttgcatttctctgatggccagtgatgatgagcatattttcatgtgtcttttggctgcataaatgtcttcttttgagaagtgtctgttcatatcctttgtataagattattagtggatttctcagaagaaatattgtagaccagaagggagtgaaaatatagatttaaaatcctgaaaggaaataaaaactagcaatgaaaaatactatatccagtaattttatctttcagaaatgaaggggtgataaagattttctcagaaagacaaaagctagatctgctttataagaaatgctagtaggagttcttcaagctgaagaaagaggatgcttattagtaatatgaaaacatatgaaaggataaaactcactagtaaaaataagtacattgtcaaatccaaaacactctagtagtgtaatggcagtgggtaaattaattatatctttagtataaaagataaaagacaaagaaagctattttaaaaactaaagctataataatgtgttaaggaatgcaaattattaaaatatgtaaactgtcacatcaaaaacataaaataggctgggcacagtggctcatggctgtaatcccaacactttgtgggggccaaggtgggaggatcacttgagcccaggcatttgagactaacttgggcaggatagtgagatctcatctctataaaaaatttaaaaattagtaaagcatggtggtgcatgcctgtagtcccagctactcaggaggtggaggtgggaggactgcttgagcctgggggggtcaaggctacagtaagcaatgatcacaccactacactccagcctgggcaacagagcaagaccctgtctcaaaaaaaataataatatgtaggaggaagggaataaaagtgtagagtttgtggatgcaataaaaattaagttgttatcagtttaaaatagcctgctaattttgtgtaagcctcatagtaaccacagagcaaaagcctatagtagatacacaaaacattttaaaaaggtccaaagcataccactacagaaagccatcaaactataaaggaagaatgcaacagaagaagaaaggatcaaaggatctaaaaaaaaaaaaagaaagaaagcaattaacaaaatgacacaagtatgaccaaagtccactgcttctttattactgatatagaatatctttcagatcttaagggactgattaattacttgggagagaaagtttgtgttgagaagatttgcttgtgttgcaatgagaaggggaagttctactcaacagaagctgtacaggcacatatgacaaaagctggtgtaagctttttacagatggtgatgctgctttggaatttgcagacttgtatgagtttaggagtagctacccagatcacaaggaaggggaggaccctaatgaggctgaggagtcgcccttaggaaaggacttagaatatgatgatgaaagcatggaactgattctgccttctgatgccagagtgggtcatcactccttgatgagatactacaaacagtgatttggcttgtcaagagctgtggtagttgctaaatattgtgaggccatgggccgagtgcttcagtaatagagagccctgggatagactggcaacacaggagcagctgttacatgaaagtgagacatgcattatatccaaaggatgaagtcaaaatggatgctgaagacagaaatgaagaacaatgccaccaagcagatgcactttagggtccaagtgagattctgagagtctgccaggattgagtgattgtctgctgcccaagtttcctccttgccctgaggaccagggaaagccagattgtatgatggacacttttgctgctacttcacttgctctaacataataataaaaatgaaaatctaaaaaatattttattgaagaatgaaggtgaaagaaatacattttcagacaagcataaacagagaaacttcaccattagcaaaagtccactaaaatattctaatgttatacttgagacaataaaaaagtgatacagaatggaaggcatgagagacaagatgggataaagagcaaacaaagttaaatatgtggataaatagagataagtatcataaaacatggtcaaatgttttatgagcgttaagatatatagaattgctttattcacagttggtttgctgtcataacacaagtatcatgaaaatcactgctaaatctaagccaaaattgggaaaggaaaaggttcatgtcactatcatcaacgttggacatgtagactcaggaaagttcaacactactggtcatctgatctataaatgtgatgtgatcaacaaaggaaccattgaaaaatttgagaaagaacctgctgagatgggaaagggctcatttgagtatgcttgggtcttggataactataaactgaacatgaatggaatatcaccattgatatctcctaaagaaacctgaggccaaaaatatcctgtgaccatcattgatgccccagcacacaggggctttattaaaaaaaaaaaaaaaaaaaaaaacatgattagagtgatatcaccaaaatggtggatagaagcaatctggcttcactctcctccagaaaaaccaaaaacaactattcagtgtctagcttatcaccaggaatatcccataactcaaaacagaggctgtgaggatctgagtggccacatagaagagaaaaactgcaagcagaagataacaaaaatgggcctgtttaactgcagcatccccttcccaagctgccaggcaccatgcagaaaagttcccccagactgacagtatgtacatcagaaaaagtgacatctagatgaagagccagctttcccaccatcttgggttcctttgcagaaaaatcattcctgcctcaatccgtgggaagcagcctgattgcctctagggtaaaaaaatcctgagggcagctagagacaaaggatggaggcggggctagcaaccccagcatgcaaaacacattggctgctcttcatctaagccaaagaagacaccaaatgagagagaatgttcagcccgtggttcctctggacacaaaatcctaaccagatgtctcacccaaccaggatatccagtttgggacctcccccaaatcgggaataggcagtaatccaagccgttgcaagagctgcagcaaatctgggcttacagcaccatctagtgccaaaaaagaggcagtaatctcagagtaaggaagctctaattcatacataacctttagacaggcatactcctgaaaaaccaaactaagccagacacaaagactggaataaataacttagcattcatacaaagacatagatatatgtgcataaaaaacaagagcaaatagggagctatgacctctccaaatggaaacagcatggagccagtgaccaaccctaatgagatggcaaattgtagctctcaaatcaataattcaaaataaaagttctgaggaaactcaaagaacacaaaaaagcaactgagaaatttatgagataaatttaacagagaaatcaaaataataatttaaaaaaccagaaatgctggagctgagaaatacaactgaacggaaaaaaaaaatgcactggaaagtctaaacagcggaactgatcaagcaaaacgaacaatcaatgagctcaaagacaggctatttgaaaatacacagtcaaaggacaaaaaataattaaaaggaatgaagaacacttgcaagatctagaggactgcctcagtagaacaaatctaagagtcatgggccttcaagagagaaagagcaatgaataaaaagctcaaagaaataacagaaaatatttccaaacctacagagagatgtaagtatccagttataggaaggctgaagatcaccaaacagattcaacccaaataagactaccccaaggcatacaataattaaactctcaaaggtcaaagacaaagaggggatcctaaaaagagcaagaaaaaagaagcaaataacatataaaggagctccagttcatccgggaatatactctggaccagatgaacctacctgacattttacagaacattttatccaactactacagaatatacattcttcttatcagcacatggaacattctccaggatagactatatattaggccagaaaacaagtctcaacatttaaaaaaataaaattatattaagtatcttttctgactacagtagaataaaactagaaatcaatgacaagaggaacgtttgaaactatacaaatacatggaaattaaacaacatgctcctgaacaaccaataagtcaatgaagaaattaagaaggaaatttattgaaacaaatgaaaatggaaacaacataccaaaatgaatgggatacaacaaaagcggtactaagagagaagtttatagctataaatgcctacatcaaaaaagaaagactcaaataaacctggtaatgatgtaactcaaggacatagaaaaacaagagcaaaccaaacccaaaattagtagaaggaaaataataataataatcatagaaataaataatattgagaaaaagaaaacaatatgaaagaccaatgaaatttttaaaatggctttttgaaagataaaatttaaaatctttagctagactaaggaaaaaaaatgagagaagacccaaataattgaaatcaaagatgaaaagagtcattaaaactgataacacaaaaatacaaagtttcactagaaactattatgatcaactatatgccaacaaactggaaaaactagaagaaatggataaatttctggacacatacaacttaccaagattgaactatgaggaaatagaaaacttgagcagaccaataactagtaatgagattgaagcagtagtaaaaagtctggcattaaataaaagtccaggacctgatgacttcactgctgaagaaaaacttacaccaattatactgaaactatttaatattgcaaaaaattgaagagaaaagaatgtttccaaactcattctacaagaccagcattatcccaatacccaaaccagacaaagacacaacaacagcaaaaagaaaactacaggccaacttcgctgatgaatatagatgcaaaaatcctcaacaaagtactagcaaactaaattcaacaacacattaaaatgagtatttgtcatgcccaagggggattcatcctaggaacacaaagatagttcaacatatggaaatcaataaatgtgatacaccacattaacagaaggaaagacaaaaaccatatatttatttcaataaatgtcaagaaagcattgaataaaattcaacatcccttcatgataaaaactctcaacaaatttggtttaaaggagcatacctcaaaacagtaaatgttatatatgacaagcccacagctaacattacaccaaatgggaaaaaattgaaagcctttcctctaagatctggaacaagacaagcatgcccactttcatcaattctattaaatgcagtcctggaagtccaagatggagcaattaagcaaagggccttcaaattagaaaaaaagaaatcaaattccccttgtttgtagacgatataatgttatatttagaaaaacctaaacactccaccaaaaaactgttagaactgatcaacaaattcagtagagttgcaagaagcaaaaccaacatacaaaaatcagtagcatttctatataccaagagctaacaatccgagagagaaatcataaaagcattttcattttcaatagctataataaaaataaatatctaggaacaaatttaaccaaagaggtgaaagatctctatactgacaactgtaaaaccctgatgaaaggaattgaagaagacacacaaaaaatgaaaaggtatctatcccatgttcatagaatggaagaattcatattgttaaaatatcaatactactagatttcatgtattacctatcaaaataccaataacatttttcacagaaatagaaaaagcagtcttaaaatttgtacagaaccacaaaagacccagatatggtttggctgtgtccccacccaaatctcatcttgaattgtagttcccataatccccacatgtcgtgggagggacccagtgggaagtgattgggtcatgggggcagttttcccccatgctgttctcgtgatagtgagtgagttctcatgaaatctgatggttttctaagtgtttggcatttcccctgctggcacttattcccactgccaccttgtgaagaagatgccttgcttcccctacgccttccaccatgattgcaagtttcctgagacctccccagcaatgcggaactgtgagtcaattatacctctttcctttatagattacccagtctccagcagttctttatagcagtatgagaacagactaatacagtaaattggtaccgaggtagggggggcactgctataaggatacctgaaaatgtggaagcaactttggaactgtgtaacaggcagaggatggaacagtttggagggctcagaagaagacaggaaaatgtggcaatgtttggaacttcctagagacctggagggctcagaagaagacaggaaaatctgggaaagtttggaacttcctagagaatcattgaatagctttcaccaaaatgctgatagtgatatggacaatgaagttcagactgaggtggtatcagatggagatgacgaacttgttaggaataggaataaaggtggctcttgctatgctttagcaaagagattggcagcattttgcccctgccctagagatctgtggaactttgaacttgagagagatgatttggggtatctggcagaagaaatttctaagcaacaaagcattccagagtgacagagcataaaagtttgaaaagtttgcagcctgatgatgcagtagaaaagacaaacccattttctggggagaaattcaacccagctacagaaatttatataattaacaaggagccaaatgttaatcaccaagataatggggaaaatgtgtccagggcatgttagagaccttcgcagcagcccctcccatcacaggcctggaggcctaggagggaaaaatgctttcgtggcctgggtccagggctcccctgcagtgttcagcctgggacttggtgccctgtgtcccagccactccagctataagaggccaaagtacagcttgggctatagcttcagagggtgcaagcccccagcctttgttctgtgggtgcacagaagacaaaaattgaggtttgggaatgtccacctagatttcagaggatgtatggaaatgcctggatgtccaggcggaggtgtgctgcagaggcagagccctcgtggagaacctctgctagggcagtgaggaaaagaaatgtggggtgggagcccccacacagtcaccactggggcactgcctagtggagctgtgagaagagggccactgtcctccagaccccagaatggtagatccactgagagcttgcaccgtgggcctggaaaagccacaggcactcaatgccagcccatgaaagcagccaggagcagggctgtaccctgcaaagctatgggggtggagcttcccaaggctgtgggagcctgccttttgtatcagggtgacctaaatgtgagacacggagtcaaaggagaacattttggaactttcaggtttaatgactgccctattggatttcagacttgcatggggcctgtagcccctttgttttggccaatttctcccatttggaatgagtgtatttacccaatgcctgtacccctattgtatctaggaaggaactaacttgcttttgattttacaggctcataaacagaagggattttccttgtctcagatgagactttggacttggacttttgggttaaggctggaatgagctaacactttgggggactgttggaaaggcatgattctgtttttaaatgtgaggacatgagatttgggaggggccatgggtggaaacatatggtttggctctgtgtccccacccaaatctcatcttgaattgtagtatattgtttgtaaaaattcctgcctatccagagattttttaaaaaaaaacaatactttcttcaattttctcttacaatttaattttttacatttaactttttaatacttcctgtagactaaaagttattttggtgcattgtgtgaaccaaagatcaaagtagttttatttttttctgaaaacatctattcattttttcaattaattgattgtttatattaaggatctaggaggatctaaaattatggaattgtgggcaagggcaatttttgccttacatttcatgtaaggcaaaataatccccatgtgtcatgggagggacccagtaggaagtgattggatcatgggggcaggttcccccatgctgttctcatgacagtgagtaagttttcatgagatctgatggttttataagcatctggcatttccccttctgtcacctctccctcctgccaccttgtgaaaaaggtgccttgcttccccttcaccttccaccatgattgtaagtttcctgaggcctctccagccatgtggaactgtaagtcaattaaacctctttcctttataaattatgcagtctcaggcagttctttataccagcaggaaaacagactaatacagaccctaaatatccaaagcagtcctgagcaaagagaacaaagctggaggcatgatgctactttatttcaaactatactacaaagctgtagtaaccaaaacagcatggtactggcataaagacagaaacatatgccagtggaacacaacagagaacccagaaatgaatccacacatttagagccaactcatttttgacaaagtgccaagaatatgcattggtgaaagaatagtctcttcaataaatgatgttgggaaaactggatatccacatgcagaagaattaaactaaacccctatctctcactgtatacaaaaattaaatcaaaatggattagagacttaaatatacaacctgaaagtatgaagctactggaagaaaacattggggaaatgctccaggacattggtctgggaaatattttatggcctgggaaatatcaaaagcacagacaactaaagcaaaagtagacaaacgggattatatcaagctataaagcttccgcacaacaaaggaatcaattaacaaagtgaagggacaacctacaggatgggatgaaatatttgcaaactatacaactgagagggtattaataaccagaatatataaggaactcaaacaagtcaatggcaaaaaagcaaaggatcctattaaaaatgaacaaagatctgaataaacatttctcaaaagaaaacatacaaatggccaacaggtatatgaaaaactgctcaacatcactaattaccagataaatgcaaaccaaaagcacaatggatatttcactccagttaaatgacttttatcaaaaagacaaaaaataatgaatgctgatgaggatgtggcaaaaggggaatgcttgtacactattggtgggagtgtgaattagtacagatactatggaaaagagtatgtatgttcctcaagaaactaaaaatagaacgaccatgtgatccagcaatcccactgctggatatatatccaaagacaggaaatcagtgtatcaaagagatagttgcacaccaacatttattacagcaccattcacaatagctaggatataaaatcaacctaagtatacatcaacagatgaatggataaagactgtgtggtatatatacacaatagactattactcagccattaaaaagaatgaaatcctgtcatttgtggcaacatcgatgagcctggatgtcactgtgttaagtgaaataagccaggcatagaaagacaaatatcacgttttcacttacatgtgagagcttaaaaagtggatctcacggagatagagagtagaatggtgcttaaaggagtttgggaatggtatgggggggtgggatggaatgaagagaggttgattaataggtgtaaaatgaaggggtggcctgcccctcgtcacccacagtgacgagaaacactgtgggtgtttctcgtcaggtgggacgagagactgagaaaagaaataagacacagagacaaagcacaggaaagaaaagtgggcccaggggaccggcgctcagcatacggaggacccgcgccggcactggtctctcagttccctcagtatttattgatcattatctctaccatctcggagagggggatgtggcagaacaatagggtaatagtggagagagggtcagcaggaaaacatgtgaacaaaggtctctgtgtcataaataagtttaaggaaatgtgctgtgccctgatgtgcacgtatacaaacatcttggtgcattaaagagcagtattgccactagcctgtctcacctccagccttaaggcggttttctcttttctcagtaaatagaacatacaatcgggttttacaccgagacactccattgcccagggacgagcaggagacagatgccttcctcttatctcaactgcaaagaggacttcctctttcactaatcctcctcagcacagaccctttacgggtgtcgggctgggggacggtcaggtctttcccttcccacgaggccatatctcaggctatcacatggggagaaaccttggacaatacctggctttccagggcagaggtccctgcggccttccgcagtgtattgtgtccctgggtacttgagattagagaatggtgatgactttttttattattattattatactttaagttctagggtacatgtgcacaacgtgcaggtttgttacacgtgtatacatgcaccatgttggtgtgctgcacccactaactcgtcatttacattaggtatatctcccaatgctatccctccccccaccccatgacaggccccggtgtgtgatgttccccctcctgtgtccaagtgttctcattgttcaattcccacctatgactaagaacatgcggtgtttggttttttgtccttgtgatagtttgctgagaatgatggtttccagattcatccatgtccctgcaaaggacatgaactcatccttttttatggctgcatagtattccatggacaagcatactgccttcaagcacttttttaacaaagcacatcctgcatagccctaaatccattaaaccttgactcaacaccgcacatgtctctgcgagcacagggttggggctagggttacagattaacagcatctcaaggcagaagaatttttcttagtacagaccaaaatggagtctcttatgtctacttctttctacatagacacagtaacagtctgatctctctttcttttccccacagtaaaattacacttaaatagaagggataagttgtagtgttcgatattacagtagggtgactatagttaacaatgatttattgtatgtttcaaaatagctagaagagaagactgggaatgttcccaacacaaataaatgacaaatggttgaagtgattgatattccaattaccatcatttgattattacacattgtattcatgtatcaaaatatcacatgtatccccaaaacatgtacaattatcgtgtatcaatttaaaaatacatcatgataggcacctctcaggttgactgtactgtcctgattattgctagtggtgttaacaaatttgaagctagtatctttaagaacgggcagacccatgagcatgcccttctggtttacacactggaagtgaaacaactaattgttggtgttaaaaaatggatttcactgaactatgccatcgccaacagagctatgtggaaatcaataaggaagtcagccctacattaagaatactggctacaaccgcaacacagtagtatttatgccaatttctggttggaatgctgacaacttgctaacatgccttggttaaagggtggagagtcacctgcagagatggcaataccagtgtagcacaccgcttgaagctctggattatatcataccaccagctcatccaactgacaaggcttgtgcctacctctccaggaagtctacaaaattggtagtattggtaatgtctttgtgggcctagtggtgactggtgccctcaaacccagcatgattggtcagctttgctccagttaacattacaactgaaataaagtcttttgaattgcaccatgaagctttaaatgaagctcttcttggggacaatgtgggcttcagtgtcaagaatgtgtctgtcaaagatgtttatcatggcaatatggcttgtgacagcgaaaatgactcgccaacggaagcagctggcttcctgaaccatccagcccaaatcagtgctggctctccacctctgttggattgtcacacagctcacattgcttgcaggtttgctgagctgaaggtggttgatttccttctggttagaagctggaagatgacccccattgtgatttttattgctatggtttctttctaatttagtcttgaggtctctcccttgagaatggtcataagccaagagagccactttctaggagagtcctgaccagggggaaagttaagtttgagtgtgtcagcttggtgagacacaatgaggaagtaaaaacaaaataaatagtggaatagaatactaacaagtacctagaaataagtctagctaaaaatttgcaaaatgtctatggaaaaaaaaactatggaaatttactgagaaactttaaagagtacctaaataactttcaagatataccacgtacatgaattggaaaacatgatatttgaaaatgtcggttattcccaaactgatttatagattcagtgcaacctgaatgaaaatcccaagacgttccttttgtagagctcaacaagctgattctaaaattaatatgaaaatgtaaaggtttatgaatagccaagtccttcttgaagaggaagaataagatgagagtaattgctgtctaatatattgagacttattttaaagctataataattaaaacaatgtagcagttggtatagggataatcaaacaggtaaatgaaatagaatagaaaatccaaaactagtctaacacatatagaaacttgatttatgacaaaggtgtcacagaagtagagtttcaataaaatgctggaaaatgttggtatctatatagataaaacattacattggattcctaactcacaccatacacaaaaatccattcacattgcattacaagtctaaaagtgaaatataaaatcataaacattttagaaagaaaatgtaaaagaatatatcaataaccacagggtagggaaagaaagagaattgacatcaagatacaaaaagccctagccaataaggtttttttttataaattccacacattaaaattacaaacttatgctcatcaaaagataacataaaaacaatgaaaagattagccacggaatggtaaatgtttgcaatacataacacaaaggacacacaaaggaaacttatataatagattttaacaggcttctctgtgtccttcttctccagcaatcaaggaatatataaaaaagcatatcaaggatatatagggtactcttttgattcaacaagaaaaaagcagattatccaagagaaaacttggcagaaaaaagcttggataggtgctccacaaaagaggacatccaaatgactgctactcataagaaaagatgctcaacctcatagaacatccaaaaatgtaaaaacacagtcaataccagatatttgtaataatttggagcaaatggaactctcatacattgctaatgaaaatggaaaatggtccagctgctttggaaaacagtgtggcaatacctaccaaagccaaacacatgcatacctagtaattccgcccaacagaaatgcacatatatgttcaccaaaagatatgcaccagaaggttatagcaggtccatatgaaagtgccaaagattataacaactcaaatgtccgtgattagggtatattcatataatactatacaacaatgggaatgaacaaactatagctacatatgataatatagatgaatctcacaaccagaatgctaagtgaaagaagaaacaaaagaatatatgtagtatgttttatttacacacttcaaaacaggcaaaactaaactatatttttaaaggatgtatacgtaactggtaaaattataaagaaaagcaaagaaatgattatcataaagatcagaatggtggttaccttcagtgggaagggagaaagtatgattgaaaagggacatccagtgagtcttgtgggttgttggcaatgttactgatctgggtgatgattgcatttatgtaccaaaggcatttgtgttttatgcactttattgtatatgttttagttcacaatttttttagttcacaattttaatagggctttaaaaagtaaaaagaaaagagatccaagggcttgaccatgggactctcttatatttggagtatgtttataaactttacattcattcaacattcgacaaatattttttgagcacctactttgtgccaagcaccgttacaggtgctgggaatacaacagggaacaaaacagacaaaaccccagctttcatggaacttacatgctaataaagcttggcaagagtatttcaaggaagatgaagtggttaactatgcaaaatgcttctcaggcacctaggaaaatgaggatgtgaggcatttctacccacttggtacataaaattattgcttttcctctgctttttttctccagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtgagttaaggacagtggaattacaagaaaattaattttatatatttattttcttgctgactataatgtattcccacttttggaaatttttaaagtatagaaaaataattccataattatctttgtgtacgttctatttttcctatgtatttttctccttatgtattcaaattataccatgcagaattctgattcttgtttttttactaaatatcacatcataaacatttcttacgtcattaaaaacacttcctatgtatgtttttaaaatactgcataatagtctattatatgaatttatggaaccatagtttatgtaaccatttattttgaacaagcttttagacagtttcttttttcactatataaataacgctgtaatcacaacagtttttctaagataaaattccagaagtgcaatgtatttgagcatcttaagagtttttcttattaattatttggtaatgtcccttgcacatttgtctttcatggaggaagtgcttttcttattgattatgttaccttatatattagatagtaaaccactgaacattttaatgagaggtactttttcaagtttttgttttctcttaattttataaatgatggtttttgaaataaaacaggttttaatttttaggtagtaacccatcaatctttactttttgacactttcattgcttttatgtttataaaaattcctgcctatccagagattttttaaaaaacacctatactttcctcagtttttctcttacagtttaattttttacatttaactttttaatacttcctgtagactaaaagttattttggtgcattgtgtgaaccaaagatcaaagtagttttatttttttctgaaaatatctattcgttgtttcaattaattgatggtgtatattaaggatgtagaaggatctaaaattatggaattgtgggcaatttttgccttacattttattttactttccattatattctatgataaatatgtataatttttaatctggaaagtaagccttttttaaaagataatatgcattcattctagaatttgtcatgaagaaccttaacttacatatcaactcctggcgttatggtctcttataacccctgcagtaacattttcccttttactctggaatggcttttatgtgtttaggaattttctcctttgcaactttgagttcataccttaaatttagaatacaaaacctcctcaggattaggtttgagttctaacagcatccatcttctgtaccacttcttccagggtattaaaaactttgataaagaccaaaagacaggtatttcttttagggatgtaaaccctaaggaccttaagatcctagaagattattcttgcttttttttttttgtcgttattgttctacaggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggtaagcaggtgtctattgtgctgaccactttttggtttaaaagaaatggtctttgtgtactaagaattttgatatttatcctacgtgcaataagaagctttaaataggagagttgatcattatatttgtgttttagaaatgtcattctggaatctactgaagaggatggattatatttttggaaggtgggaggcaggttggactggcataaaaattgatgagaaatccactctggttcataggtgagagagcttatactcataggattgatgtcttccctccctaggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatggtaatatattccacatccaaacattatcactgtgaaatgcagattgcactttgacaaatgagacttgatccagggacttgaacattgtatttatttagagtatatctgtgggagtggaatcctcatagatgtcagtttttttggtggagtggagagaaagaaacttatataatagattttaacaggcttctctgtgtccttctccagcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtatgagcttgtttgtgctctttcttctacctactctatttgttgagtacttactttaaatggtctaggcactgggaacacaatcagtgatcaaagcagacaagctccatgctcttaagtaatactttttcaaatgctttttaaaccatttgttcaaagcaaatgaacaagataatttcagatatagaaaaattgctaaaaaggaaatagaacagaataaatggataattaatgtcacagtactttcctagggaaaaggaatttattcctttatcatttaccatctcaaatcccatagggcaccagtagtcatccaaagagtcatttgtttatgtatgtaaccagtatattgattaagcactactcataatgttgatcacaacacaattttattttggttcttcactgtccctttaaaatagatttggccaggtgcgatggctcacacttgtaatcccagcactttgggaggccaaggttggaggattgcttgaggccaggagttcaagaccagcctgggtgacaaagcaagacccccatctctacaaaaaataattagccagacatgtggtatatacctgtagtcccagctacttcacctacttgggtggctgaagtggaaggattgcttgagcccaggaggttgatgctgcagtgagctatgaaagtgccactgcactcaaacttggacaacagagcaagaccctgtctctaaaaaaaaaaaaccatccagtttaatagcgggggtaaactttccttatttcttcgtaaaaattctgataagccctgtaacttttctgctcacccttaagtaataaacaggactaaagtcactttatgtcacaaatacagttcaaatcagaaattacaatgtccatcccaagatattaatcaaaattgtaaacttgatttaacttcaatctcccctcctccaacttgagcctgcatcaggctggaagtctgcattggaaaagggagacatggttgagtcctctgtttctgtaccttgtgatgatcgtgcttccccacaacccctttatagctgctgttttgaactccaacatggataggttaaaggtaaggggataagatagttcttacctatttacagctggcaccattgttgtaaactagcttaacactgtttgtgcctggcaatacttgttgactctttctcctgcagggcactttcagggaactctttagagactcccttacgtgactgtcatgaaatccccttgacatgatttcttccacctttactctgggtggtcacttgtgactcatttctcagccctcagtgttcacctgcagcttcttgttgctggggtaactttacccttgtaggcagctctagtggactggatccagagggaactcaccctgacttatctgtttcacagagtccacatctggccaatgggaaacacaccttttgctcagaaagaccctgggaatgtaggtcaatcataatgcagtagcattctcctgtcccaaccatcaaagaattcagtcaccctgtttctcatctcctggggggaggggagtggtcagaactcaatctccacaacccccaactgtaagggtcacgtagcaagcactttgcatttgaggggtccaaaagtagtggaactaccaaatttggtaggtctactctgatatttcgcataaaccaatgtatctcatgctcattttttagtgaaaagaaataatttctgttcctgttggtttttataaggtgtttttgagacagtggaaatgttaccatccaaagctggaatttggcgggtggaatgccttattggcgagcatctacatgctgggatgagcacactttttctggtgtacagcaatagtgagtagcaatgtgggcagaggttccctacctactcagcctacttctttacagctttcttcctttctggaatggttgcttgtgtcaggaaataaatacaagtttacatcattatcaaatttaaaatgaatattgctggtagaaatcatcagagttctcagagtagggcagatatacttgaagctttgaacactttgtacctgaagctctaaataattgacaaaaaaaaaataccacctcattttcacaacttggtaaagctcgaagatctccagtagcagattttggaatttaatgttgatttagttaccagataacttagaaatactacttggaagagtttggagatttaaccctaaacaagtaagagagccactggtctatttatgtacggaccccagtttcttcagctgtaaaatgtgaatcattctagcacctgttaggattaattaaatgaactaatacagtaaaacgttgagtacagttcttggcacatttaaacactaaaaaatagcatttgttgacgttctcccattttcattgacttacatttgagaagctgaattttgtgcacttctagttactgtgttccacccgtttcatttcagagtgtcagactcccctgggaatggcttctggacacattagagattttcagattacagcttcaggacaatatggtaaatactattatttttgctccaagaacctgggctgattatatctttttttaataatctggtggagaatctcagataatgaatccatctccatgcttctattagttctattccataagtgcctctcaaatacatctcctcctctccacttcccactgtggccatcttaactcaggtcaccatcatttcttacctgggcaatgacactgcctccttaaatatcctccctaccttcagtatttcttccttgagtcaattcttttcagtgcagcaggaagctatactttcctatgagcagtaatggtaaagtttgactagggtctatagagaattctcagaaattgttttagagcactactgcccacaggctaaatgcagcacactgcctgtttttgtatggcatgtgagctatgaacagattttccatttttaaataattgtcaaaaagatgaagactatttcatgacatgtgaaattataaaattcaaatttcagcatccgtaataaagccttattttggaacacagccacgtccattaatttacatatcatctatggctacagcagcagtaacatagttgcaacagagaccatataatatgcaaagcctaaatgatttactatctggccctttacagaaaaagtttgccaacctatgttgttgtgaggtaaaaaaaaatcctcttgaaaaggaggcgtgagagttttacaccaaaatagtaacatttttcactaggtggaagggttacattttaaaatgtcttttatttgtatttttactaatttttacttttcattttctgatttttctacaatgaacatacattgcgtaataaataataggcggggcacgttggctcatgcctcccagcactttgcaaggctgaggcaagcagatcacctgaggtcaggagttcaagaccagcctggccaacatggtgaaactccgtctctactaaaaatacaaaaattagtcgggcatggtggtacgcgattgtagtcccagctacctaggagactgaggcaggagaattgcttgaactcaggaggtggaggttgcagtgagccaagatcatgccattgcactccagcctgggtgacaaagcaagactccatctcaaaaaaagaaagaaaagaagaaataatattattatttggtagtgttggtaacaaattgcagtatcagctagttagaggtgctaacaattaacaaaattataaattttagaaaataaaatggacaacaaggataagcaatatccttagatagtaattgatactggtatgccataaagcctttatgtttttctctattttcaccacagcttagattaacctttctcaagacaataattttattctcaagtgtctaggactaacccagctgaatttaatctctgtttctttacttgggcaaaggacagtgggccccaaagctggccagacttcattattccggatcaatcaatgcctggagcaccaaggagcccttttcttggatcaaggttagaaaatgtaatcaatgatgggaaatgtatcacattcaatcaattgcattacttattcctcttgcaagctcaaaggattctatgaatatgagaaaactaaagaacagaatgccttaatgatttgtacaaaagcagtcatgaacaaagagatatggggatagaattgagtatattgatatgtcctgtttctgtattttagtccttctactgggattagaacatctgaatattttctataatattgaactcgtcatctctcaagacagtatatgttattattagatgcttccaactgcccacgtgtccttaagtactccaatcccctttattttaacataaaacaaatggttcacaaatgcaaaccacatgtgtacttttacattttctgtagccacgttttcaaaaatgtgaaattcactttaataatacattttatttaactcaacatatctgaaaatactatcatttcaacatatgatcaatgaggccccttcaaagacagacagatggaaactcttgggtctcttccatgcctcacaaaagctgagggcagcttggaagtgcctgctcagcctctccacctaaacataaggctagatgccttctagaagcccaaacaggaaatggagaaaacattttggtttccatctttgcaaatagcatgtctattaatgccacagcattgttttgtagacactgccaattttgactcaatctgagctgctgttcactaatccctaagtattttttgttggtttgtgcttctgccaaacaacatgttatgttcttcaccttgtatttctatggttattttcaaccttaagtgtatccctatatagagaacatgtttatctatttggccaccctgtgtctgtctgtgctatttaattttttgtaataacattcttatttgggagggcggaattatatcttcctcactagatacaacctgataagactagtaaatagagtgtcctgtctgtgcctagccaatgaaccctgaatgatatactctgttgtttccacttactagatttggcccattgtttcagcttgccgatcttcagtgtcccaaagtatttcctagtttttccagttactgatttgatcagtaaactttctaatactgcagcaaagtcatgatcaaaatattgaagtagacaagacttccttagtatgtgcacaatacaaatcaagctgttaagtccttactacaaccttgtgaggtagatgttactatcatcttcatttcagataatgaaattgaagcatagagaggttattgtggcccaagtcacatggctaataagtgactgagccaaaattcaaattctgatagttgggctccagaaccctaactggtaatcgttgtactacactgtttccggaatgctccctttaagttgataaccatctattaactgtcactgttcacttgtggtaattaaaccagttacaaatccacctagttatgttatcatctaccactattgaatcgccttatcttcaaggtggttttgccatctgtcctactaaggtccagctagactttttatagatctcgtaactttataaaataaaccatggagatggagttgaaagggggtgctgacaaggaagggagttggagaaggcatctattctcgtgagaaggcctgaagagtgcacaacagcctggccccaagacacaagagcactgggctggcttgaggagcaccaggtgaccaagaccaggcaatgcacagggggaagtcagcaggccccatggagatacgcagctgcagtgtttgtacttttatacagtgaaactcattaccaccttgcttacttcctagtagagagatgtgtcttgtagttacactgaaacacctggctgggcacataggtgaagctgttgagtctgtaattgtcaaactgctcccaggtgccaattataatgtagaagaggcacaagaagatgaagtggataagcctggcagtttgtcaagcattcatcagttgtcaagcatttgtcagttgcagaatgtaggtaggctgccaaggctttattgtagcctggttctattgcagctttattctagcaaggctgctggaaaatacaataatcactggtccaagaaagaactcttatactctatctatatgaagaaacagtaaaagtcaattcagtagaaatcatgatttttgtgcctggtgctttcacttttttatgccacaataccaagaggttaaaatgaagtgtctttgattgggaataccatctatctgggaaaagacagggctgcaacttctgaagaccttgacactctgtcctgttaccctgcttcatttttctcctgcgcttatcactacttgatgctataaacaaataaaaacatatatgatataaggtctatttctcctactcaactgtaagttccatgagggcagggctttctttcttgtttactactctattccctgtatctaaaacagtgcttggcacatagcaagtgctaaaaaatattctttgaatgagtgtatgaatggaacttacagtcagctgaaggagacagttattaagcataagagtgatgaccagtccaattgtgtgtgtcaggcatgtgtgaaaacgtgctaaatttgacttgcttattaggacagtaactgatacttctaatgttcttgcagcccatgacctcttctttaagaagtgtccattctgtactactttcccattattcactcattcattccaaagcatttgctatacagcagtattataccagataccatattaggtgctggggctagagagaatataaaagctaacattgattgagtgtttagtatgcgccaggccctgaactcagcacattacatgtattaactctttaacccctatggcagccctttgagataaaaactaatattatcttcactttacagataagttgagacacagaaagttaggtgactcaaatgggttcactgccttaaggatctcagtctaataaggaaagcagaaaagcaaagcaaccttataatatggtgcaataatttgctataatgaagttatatacaaagtgaagtagaagcatagaagaagcagcactaaatttgtctgggtgagtcagagaaggctaaccaggaaaaatagtttctgaactaacacttgaaggaggtgtagcagttcatcactgacagtgatgttggggtgggtctggtttcaggagaggggaggaaattggctttggtctgaggctgaggtgtgggcaaagcattagcttatgtgggtccattagcttatgtgagtccacaaaaggtgtgtgtgtgtttgtgtgtatgtgtgtgtgtgtgtgtgtgtgtgtgtgtgtacgaaatgggggctcaatgatttggtagtggtttggtttgtcaagaagcaggctgggaactcaataagcatctttccattcatttctactgtgtatcccacagcttcacacacacatgcacatttcaacattggtgactgcttcacttgcacacctaaggtaatgatggacacacctgtagcaatgtagattcttcctaagctaataattagtttcaggaggtagcacatacatttaaaaataggttaaaataaagtgttattttaattggtaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtatgtaattagtcatttaaagggaatgcctgaatactttaaagaattttggcagatttcagatattggacaaacactcttagcttccacaaacttaattccaaaaaataatttttcacttatgagcaatagagttattacggacatatcagcaaaaatgtagtagtgtcaaggctcatagatgatagaaatgaagagatgctgtattgatagaaatatgtgattcaggactgtgtggattgatgattgtgagcttgcttatggatatcctaggtttgaggttatagtaggacaatcaggttgaaatgtccagcaggcagtaggtgaaagacaagtttagggggcaaaaccatggatggagatgaagattcatgacttccacataaaaggatgggtgaaactttgggaattgatgaattctctagaggtgagctcaagacccttaaaggcttaaaacctcagcgttattgtctactcttccctcatttttatgcccacaaatctggtcaatcctttatttgcaatgcctctcacatctctttcttctgtttccatttataccgctgttgccacagcccagggtcccatcacctcacacttgatctattgtattacattcctaactagtcttcccccgtttctaatctgttctccgataaaagctgcacatcattttcaggataatcatcagtcgcctgcctaaaacttttcaatgtcttcccattgtctttagaataaagttcaaagtcttcaaatgaccccaagcaagataacttttgtttgcccctttagatccattttcctgcttctctaccctgcttcttgttctgtgaggtgagcttgtatagaatacatcaacaggttaccttgtcctccagcttttggttggatttcaccaacagggagcactggcaaaagattggcatatttattcttctgactttctccttgcagaggagttcactgtatctccccacttaaggtcactgtttccctcagagtggctttttctacctgtactagctactattgctgtgtaccaagccacttcaaaacttgctgtcataacaataaccattatgttttgctcacagattctgtagatcaagactgggacacagtggggatgggtggtttctggagcctcagttaggattatttaacagctgggtgctggaatcatctggaagttccttctcttgcttttctggtggttggtactgactgtcagctaggacagaatctggggttgttgactgatgtaactttacatggattatccctgaggcctggccttccttacagcatgtttcaaggtagttggacttctttttgagggggggtaggaaggtggggggaggacagagtctcactctgttgcccaggctggagtgcactggtgtgatctcggctcactgcaacctctgcctcccgggctcaagtgattctcctgcctcagcctgctgagtagctgggactacgggctcatgccaccacacccagctaatttttgtatttttagtagagacagggttttgccatgttgaccaggctggtcttgaactcctgacctcaggtgatccgcccacctcagcctcccaaagtgctgggattacaggcacccggcctgtagttggacttcttacacgtcattttagggcctccaagtgtgagtgttacagttaacaaggtgaagactacataaccttttctgaccgagtcttctaagttatgtagcatcacttttgttgacaaaaagtgttgaactctataaaatatttgaagagatttattctgagccaaatatgagtgagtatggcccatgacacagccctcaggaggtcctgagaacatgtgcccaagatggtcagggcacagcttggttttatacattttagagaggcttgagacatcaatcaaatacatttaagaaatacactgatttggtccagaaaggcgggacaactcaacctgggggcttccgggctataggtgaatttaaacattttctggttgacaattggttgagtttgtctgaagacctgggattgatagaaagggaatgttcaggttaagataaacattgtggagaccaaagttcttttgaagtcttatagtggctccccttagagacaatagatgacaaatgttttgtattcagatcttagttaatctctttaggattgggaggggctgggagaaaaagatctagctatgttaatagagattctttacagttgcaaatttccctccacaaagaacagctttgcagggccatttcaaaatatggcaaaaaaacatgttttggggtaaaatattttgattttcttccttgtctcataatgttatgccagagtaaggttggaaagtaaatcatgacatataaggttaaataaaacccatctgatgagaatttatgatttgtagggcatgactccccagaccccttagataggaatttgggcaagataaaaaaaaatcagagtttagtcctcactttcaatacattctattggttataagcaaatcgcatatccacccagattcaaggggaagagacatagaccctaatttttaatgggagaaatgttaaataattggtggtcattttttaaagccactacaataatctatccaattctctctttcaggatgtttctctcttctgatcctttcaggtttagggattgtcaacaaacaaaaagttaaaccctgtaaaatacttgaagagatttattatgagccaaatatgagagaccaatggcctgtgacacagccctcaggagatcctgagaacatgtgctcaaggtggtctggctacaacttggttttacgcattttagggagacataagaccgaaatcaatagatggaagatgtacattcattgagtttggaaaggcaggacaactggaagcgaggcggggcttccaggtcgtaggtagattcaaagattttctgattggcaattggttgaaagagttaagttattgtgtaaagacttagaatcaatagagaggaacatcggggttaagataaggggttgtgaagaccaaggttctgtcatgcagatgaagcctccaggtagcaggcttcagagagaatagattgtaaatgtttcttatcagacttaaagagtctgttctatcagtctgaaggtctgtgttgatgttaatgctggtcagatttttctgaattccaaaagggaggcgggtataataaggcatatttgatccccactttcccatcatggcctgaacgtttttcaggttaactttggaaggccctttgccgaaaggaggggggattagaattttattttgggtttacaggatggtaatactctgttcccaccctcctaactagtatctttattaaaccttccacaaattatcctaatttccatgttttctgttccttgctggatcccttgtttcatacagtaattggtgctagaagaaaccccaggaaacagattttcaaaatgcaattctaaggttatgttgctaatatattcaagaaacacagagataacatatttgccaaggaagaaaatgagcagttagggaatccatgacatgtgttagtattatagtttctcagattatcaccagtgatactatgggatgagttgcagatggcaagtaagacactggggagattaaatgacagtggcatttagtcactgtggcaacaaacgtagcattacctgattgtagagtggtctgtcttcttacagccctagagggcatacacatggaaaaagaaatgaaatgttatgaatatatacaaaataagaacactgatgaacatacatggaaaatcaggatgcatgcatagagcttttgaggaatactccgtatcctgtggttgtaggcagatacgacttaggggctgagcataagttgcagagctgcagtgacaattaaatgcttaactccaccagatctattatgctgtggtaagagtaccggtgggaaggagtgaaactctgaggcctgagatggaggcatttaggcagacatggatgaggctgagaattgcaaacctccaaattcccctgaacctcctttgcctgaggaggcaaccactccccagtctctgaagcagtcatccctcttttgtgtaaaagcctttcagtggctataactgagataggtgcctcacaaaccagtgactattctccttagagaccctgtttggacactacgaaagccaggcgagtcacagaaaatgacagcagatcacaaatttaatcaggtggtgatgccaaaaaacaattgcaattccagatatcatatctctgttgaagcaaatttacacagccccaggcacctgatatggaagtattgacctagagaatgttttttcttcatttccatacattagtaaaatcagaatacatttgaatttaccaagtaggaacaagagtattaagtttactgcccatgcatcagggcaatgttagctctcttgttttctatcataatatagactcaagggacctcaaacatctttacatcccacaagcacaatgcctgtccattacactgatgacattatgctgacaggatctggtaaacacataacaaataagcctgtcttgctcttgactttaatgagaatgtaacctgtgtttcactgtttaatataatgttcactgttagtttcaaatactttttatgatgtttaaaaagttttctcctatccctattttatttgcaatggcaactgaattttatcaaatgcttttccagcatctttgacatggtcacatttctcttttgtgttgtcaaattatacttaacattcaatagtgtgctgacaagaaattaacaacccacaggggagcaaagtgagaagaggttaagaagtaaaggccttgatttatagcattggcagatttccctgacataaatactactcccatcatgcctggccccagggatgggaagagatgcttacttacaattggctctcacagaccagtgcaagagcactactgtgctccatttctgggaaaactttcgtcagtcatagtgtgttagttatttaaaacttagctggatccaatttgccaacatttcatttataatttctatatctatattcatgaatgaaatgggtttagctttttcagtagctctacttaccaggttttggcatgagggttatattaaacttgaaaataaagtgggaaagcttccatttttttccatgaagactattgctctagaatagcttatttaatgtaggaatccagtatttaatgagagtaaatgaaaaagccatatgagccatgtgctttatttagtgagagatactaggctatattttccaatcgttatatgattattgctattctcatttgtgttgccttgagttaatgtctgcaaatgtgcacattagagtcatatatcccttcctgtgccatacatctatatctgtatacacacatatgtcttttctccttttttcccttctgtatcaagagttggcaagtgtttgtctattctattaatttttcaaagaatcagctcagttttaaacccaaacgtggttttgaaagagctgtttctagttcatcaatctctgttcaaaactttaaaaattctattttcctttcttttggtttgtttcctacaatctggaggtgaatgcttagttcacttattcttcaatctttgtattttaacgataaggataaattacttacagttattaactactctcatgaggttcattccttgaacagtcactgagcaactactatgtcctgggttctaattcaggggtgggcaaactatagccccagaatttggcccatagcctgcttttgtacggactgtgagttaagaatagtttttacacgttgaaaggattgcaaagacaaacatacaaagaaacaaagaagactgtgcaacagagaccacctgtggtctgtaaagactaacacatttctatcccgcccttgacagaaagagtctgtgggctgctggtctcctctaacggtggtagagatgcctgcacggttaacattaatccttggcaccagaatcctcagcacctaggaaccagatcttgcctaacacgctaatttcagtcttgaccaccttcctccggcgtagcggttctcaaacgtctttgtctttgtactattcacgtataaaatattctttcataagcaacatttatccttttgggaatacctcacaatggggagaaggggaaccccaacagcctttaagggttcactgcttcgctgccaccatttccgacggtttacactgttttaagtgtgaatttggaattgttttcaagttaaaaagcaaactaatcatgtcctctgaaagtatttgcttttggcatgctagaaatcagtgttgacttttgatactgatgtgatacattacgagggaattctcaaaactgctgaaatctggcctcggcccagttatcactgctcttaagcttctgagggagatacatgaatgagcccacggcaaatggaaaacgaggagttttagtgtttcctagaattatgctcagatacccactacctgaccgtctggttatccttcccctcacctccctgacgcaaggagtttggaccagaggcctaaggaggcttctcctgaagcccaaatcccaaactggtcaccagtcatgctccgtaactcctgaacctgacaagaagccagccggccaggtctgcagcccgggttaagaggagcataccaggaaagagccaaagagcaaaggagcatgagcccttcaaccgcttttacaataatttgggctaggcgttcagggctccgtaggacccttcctggcagccaagtgagagaaagaggaatgatggtggaatgggcctctcctgtgcttcccattacttccacactgtcgaaatagaaatagaagcagaaaagaacaccctacaagtcccacccatttggaggcactcaactcacagtgacaaccctccacacctctcccctgcaaaaagacgcaaaacaaaaacacctactccaaactgtgtccttacatctcagccccgaagatcaggattgtgtgcaacttcggcccaaaggatgcatttccccagggttgaaagtttgagaaagaggctatattctgaagagttcttgttgtcaccatcaaaaggattaaaaagacgcaataaataagaaaacagcgtagttggggggcatgctccatttgagccagaaagccttggaaacttaagtgttctcaaacggaacgccatcctgctttgggggaacacggaggctgccttgcagtcacgtgatcgcacaacaccaaagggccacgcactctgatttcacctacttaactaaaagttgcagcaaaatccctattacaggccaggcgtggtggctcatgcctgtaatcccagcactttgggaggccgaggagggtggatcatttgaggtcaggagttggagaccagcttggccaacatggtgagaccccatctctattaaaaatacaaaaattagcccagcgtggtggtgcacgcctgtaatcccaggcaccctggaggttgaggtaggagaatcgcttgaacccaggaggcggaggttgcagtgagccgagatcacgccactgcgctcctgcctgggcgacagagtgagactccatctcggggggaaaaaaaaaaaaaaaaaaaaaaaaaatccctattacaaataaaagctgttgtgatccagactgcatatacctctgcgaatggaaccagaaccgtgaattccaatgcaaatcgatgcatcggcaccagacccgctgcactggatgtatctgcattgcagtcacccgagtacggagcacatcatagatgatctctgcaggttcgttgcccacataggaggcatagcgcaaatttcaaaggaacgaatacatcctggagcccaaacagctatctggttctgctgctggcctcctgacaagtaggtaagagagtcacattttatagacgacggacaccaaaaccacacatgaggagtacaagagtagctttatcatggatttagggctgtggttacaaggaagctgtaaggaataaaatgactcccatgaagacgtaccgtgcggacgagtggaaggagaaatttggccattacaaagacacaggaatatgttaagaagtgaggggcaggatgaaatcatctagggtaggtatttagagggagggcgccgtgcaaaataaaatcctcactatgaaacaaaggcggaggcaggaggctgcgttaggtggaagcagcggaggaaggagacgaaagggattgtcattttcatgtcgtggctttttagaagacagccatgtcctctactctgattctatcaaaatgtgttctcggggtgctggtaacgttcagccaacgaaataattcctatggcggcagtaggaataacaaaacgcagaagcgggaacgatgtctttttattcctccccagacgcaaacgtggatgcatgaggtttggtaacaggcaaagtcatctggttaacgtgactgatgcaaaaagtccaggcctgggcaaaaagaagtcactgggtgaatgggatggatcagactccctgtcctgagggggagatggtttcttgcagaacgaggtgaaggaggtggttctgctcagcagtcaacagtggccacatctccacctgcagcgacttgatggcttccgtgtccttttcgtgggtagccatgaccaaagactggagcagcagaaagagctcctcgggaagctggccgctgctctcctgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcgggagagggcgccgccgagccggagttcggaggaagcagcgcggccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtagtcgcgcgccagcagctggcaggaggcggcctcgccaagcgcctgcagcgcggccaggggcagctggggcagctggagctgggcggcgcgctggaagtgaccggcggcggcggccggctggcccaggtcgcgcagggcggcggccagctcgaggcagagggcggcggcggcggccggctggcccagctcgaggtgcagacgcaccgcggcgcccagggcgctggcggcggcctgcagcggctccccgtaggcggcggggcagaccaggcgctggcgcgcgtcgcgctcctgccgcaggaagaggcgggcggcctcggtgagggccagcgcctccccgggcccgtggaagagcgcctgctggcagcgcgccaccgccagctggcaccaggccgcgtagggcagacactcctgggcgcgcagctcccggcccagctgtccgaactgctcgccggcctccgccacgttcggcttccgcaggaaccgcttcttcagcttgttcgataccagccggtagcgggccaggaagtccccggcctcgggtcccgggccggcgccgccgccgcccaggcctgcagccgctgccgccatgctcgccgccccaagcacttcccgacgcgccgccgcagctggcgggcgggccggggcggggcgacgtgccctgcgtccccctcggcgggctgccgccgtgcccgcgccggctccccagcccgagcctgccccttgccctgatgaggtgcaaagagcgggatcggaggcggggcctggccgggctgtgagcggcgtatgcaaatcgagggtctcggggatgcggatccaagaccctgggaaggtacgcggggcctggcggggcaccagctgctgctagctcggctgcaatgcaagtggtctaggttgctaaaggcatcccacagcctctccatctgaacatgacccaaacgaaactcgtgaccctaattccatgtctgcgcatttctagactgttgtccccccccccccccgccccgactactcagtcctccgtcttccggtccagggccccttgccaagcaccgggtccacctctccgtccccaccccggttgccttagaagtccgtcctgtcgcaacactgcagtcatggtcttgaggcccacccgccccaacgaacaccatcatgctgaggactttcccgggcaggccctgacttgctcagaaccagcgggggtgtccccttcccacccagggccactcccctgcactgtcacccggagagactgctcctctgtgccatccctggctcccacccaaccccagacccccaccacctctccatccctccagctgtggaggtctcacaaccccccaacccatctcaccgcccccccacccccaccccaaggcaaagtgactgaagcgggcagatggcttccttgaaacattttattgacagaattaatgaaggcccaagactttggggcctgggttgtggggggagggtgtttaaggccgggggttcaggccgggggatttggggccgggtgggtggacgagtggacctgtcaggtcccaggggccgggtgtcagaagctagtcctcgccaggggccacttgagagatggtggtcgtgttgaaaagggtgctcagtagcctgtcgttgtgaaccaccatgtccagcagcaggggagtgatgttccgctctccgctgttctgggcctcgttgcccgccagctccgggaccttggccgtcaggtactcaataaccgcagcgaggtagaccggcgccgtgcgactcaggcgctgagcgtagtggccctcccgtagactgcgctccacctggctcactgaaaacgaaagctccgctcggacggtgcgagagcaggtccgcccccggccgccagcaccggaggaccctcggcgtctcctcctcctcggcatgctgggcgttgagtgtgctatctcggcttggcccagctaggcaagatggctctcaagaggacagttaccgcgtccagtactgtgtatcctagcgaccagggcccagcccctcattggctagggagccgagaccaatgggcacgcacatccggcgacgggcacgcatgtggtgacggcccctcacaagggacacacgtccgtcaggtgacctcatcactttcccattggcctcgagggagcaggcctgggcctagaagtggctggagggccgtgggggtggggtggggcggggcagggggaatcgcgctggtgaccctctctttgccagtgggaactttccctttctactggatgggaacaccgtgggaaagacaaaggggtgggcgaggggaggacgggtaccacgccttcacaatgttgcacatccatcacgaccacctagttccaaaacgttttcaacaccccgaaaagaaaccgaaacccctgtacctataagcagtcacttgccgcacgcctccttccacaccaccactaccagcccccacaccctcccacacacaccccctgcccccgcccatacacacgttcccgatagtccctggcaacccctagtccatctgctttctgtccatagaggttagcctgttctggagatttcctatagatggaattatacgaccaaatgtgaggccgtgtgtgtctggctgctttcacttagcgtaatggtttcatcagggtgcatccatgtagaggcatgaatcactacttccttcctttgaatgactgagtacgattctgttgtatgaataggaggccacattttgtttacccactcgtcagttgatggacaggttatttcccccttctggctattgtgagtggcactgccatgaccatctctctacaggtttttctttgaatatctcttttcagttcttttgggtctatttctagcagtcaaactgctggctcgtgtggtaattctgtttaacttattgaggaaccaccaaactgatttccacagcagctgtaatctttcgcattcccaacagtagtgcatgagagtcccaatttcttcacagcctcatcaaaacctgttttctgtttgcctcattttgttttgtttacagtagccatcctactgggtgtcaagtgctatctcatggtggttttcattcgtatttcccaaatggctaatgatgttgctgtggtttgagtgcatcccccaaattgtgtgtcttggaaacttaatccccaaattcacatgttgattggaggcgcagcctctgagacggtaattaggattagataaggtcatcggggtgagacccccaggatgcgactggtggctttataagaataggaagagaggcctgaaacgacatacacgctcttgccctctcgccgtgtgataccctctgccgtccccagatgccgggtcacttcccagtccccagaacggtaagaaataaatttcttttctttataaattgttcagtgtcgggtattcaattatggcaacagaaaacagactaagacatcttttcatgtgcttcttggccctctgtacctctgctttggaggaatgtctattcaagccctttgcccattttttaattcggttgattgtattttggctgtgggcttctaaaacttattcatatattctggaaaatagactcttatcagatatgtgacttgcaaatgtttctcccattcactttctggatagagccctttgttgcccaaaagatttacatttggatgtagtccaacttgccaaatgaaaagatatctgtggctttgcctttggtgtcatactgaaggagctgttgcctaatccaaggtcgtgcaaagttacatctccgttttcttcttagagttttatagtttcagcccttacatttagatctgtgatccattttgaattaattctttacatgatgtgaggtaggggtccaggggccttcttttgcatgtggctatccagttgtcccagcgcagtttgttgaggggattattcttcccctccacccattgaggggtgccggaactcttactgaaaataaactttacataaatatatgggtttattcctgactctgagttctgtaacattgacctaatgtatcgatcacgatggcagtaccacccttttcggattactgcggttttgtagtacgttttgaaattgggaagtgtgagtccttcaacttttttcttttctgagattgttttggctatctgagccccttacattttcttatgaattttaggatcagcttgtcagtttttacaaagaaggcaggttggattctgacaggcatcacgatgaatctgtatattgccttggagattatgggcatcttaacaatattaagtgtcccaatccgttaacacaaaatgcctttcgatttatttaggtcttctttaatttattttagcaacgtcttgaaattttcagagtatacatcttgtacacctttagttaaatttattcctcgacattttattgtttcgatgctactgtaaaatgaatcatttccttaatcttattttcatgttattcattgctagggtgtagaaatacaaccgactgttgcagattgatcttggatactgcaactttgctgagccgaatatgctttgctgagcatactcagacagggttggcatattagtccgttcctacactgctataaagaactgcctgagaatgggtaattcctaaagaaaagaggtttaattgcctcatggttctgcaggctgtacaaggcttctgcttctgggcaggcctcaggaaacgtgcaatcatggcggaaggcgaaggggaagcaagcaccttcttcacatgttggagcaggaggaagagagagagaacgcacgcaaagggggaagcgctgcacattttcaaacaatcatcagatcttgtgagcgctctatcagaagaatagcaagggggaagtccgcccccatgattcaatcacctcccactaggcccttccttcaacaggtggggattacaattcgacatgagatttgggtggggacacagagccaaaccgtctcagttttttttttttttcttttgttggactctttagtgtcctctatataagaacatgccatctatgcatctatgaatagagatggttttacttgttcctttccgatctggatgccttttatttctttttcttgactaattgccctgactagaactttgagtacgatgttgagttacaagtggcattcctgatcttagggggaaatcaaccagtctttcaccattaagtatgatattatctctgggtttttcatggatgccctctatcaggttgaagaagtttctttctgttcctggtttgttgaatttattttcatgaaagggtactgcgttttgtcaaatgatcctttttgtacatgattaagatgaccatgagccccctcccccgcccccgctccgccatgcattctgttaatatggtgtattatataaattgattttcacatgttgaaccaaccttacatttgtgggataaatcctatttggtcatagtgtataaagagtggtcaataaacatttcgttgaaagaataggagtggatctggcaagcttcttggaggacaatgtgtgtgttaaagaatctgtagcatgatgagaagccaaggcaccggtgggaggaggggagttgcaaccaattcattaaggctggagagtacgatgccagtggagcagtagtggttgatgtggctgggaaagaggtaggcaggagccaagacatggaggttctattatgccatgctcaggttttagaataccctgtaggctacactgaacccactgtggtctttcagcttgggagtgacgtggtctgatttgcctctagaaatatcaccctggaagctgtgtggagaatagaacagagaggattgtgtgtggagaatagaacagagaggactgagattggaattagaaagctgctgtattataccagtcaagaaatgacagatatctcaactaagacaatggcattggtagataagactaggggacagagtccataaaaagtttaggtagtaaaatggcacacagtagacactcactacatattactcatactggtgaacctagctggagacatgataattcatgtgctcattcttcaaaaaatattgaagggtagtgccaggtatactgtgttaagcattgagacaacaccaacgagaaatattctgttgtataaataggccacattttgtttatctactcatcagttgatgaacagttcattaaatgatttccatggcaggggaggtaaatgttgtcctctatcctcttagattctccagctaggacttaaataagatagattaacaaaagaaaagcatacaaaattttatttggcattttttacatgtacatgggagccctcataagaaatacgaagactcaagtgattaattacagctgaatacttacatactagggtgggaaaagtatggtaaattgtgaaaacataacaagacattggggtttgggctaggagagttaattgtggaaaagtcactaagaaggtaagagttgtgtaacaaggttttttggtgcagctttccctcaagcctggactccccatctctggcaataagaatgtgtttcttcttcctggtatacagataatacctttcacatcagagtttcatctcttcctttcatgaaaaaaaaaggaaggtcagtgtgcccttcttgcatctgctactttcaagtgcctttaaacacaaaataatcaatatgccaaagtggcatattttgaggtggcatttgatcccctacattactgattggatagtgtgaatagtgctgccatgaacgctcctgtacaagtgtttgtttgaacagatgttttaaattgcagacgctcctcaacttgggatggtattatatcctgataaacccattgttagttaaaaccattattagtgtaaattcatttaatacagctatattagtccattctcacactgctataaagaactacctgagacttggtaatttatgaagaaaagaggtttaatggactcacagttctgcaggcttaacaggaagcatgactgtgaggcctcaggaaacttacagtcccagcagcaggtaaaggggaagcaagcacgccttaccatggtggagcaggagagacagagagtgaaggacggaaatgtcatacacttttaaaccatcagatctcatgagaactcactcactgtctcaagaacagcaaggggaaatccacccccatgatccaatcacctcccaccaggcctctcctctgacacacggggattacaattcgatgtgagatttgggtggggatacagagccaaaccatatcagcggctaacctaccaatcatcataatttagccaggcctaccttaaacatgctcagaacacttacaattaggctacagttgggcaaaatcatataacgtaaagccaaatttataatgaagtgttgactatctcacgtaatttattcaatattgcactgaaagtgaaaggcagaatggttgtatgtgtactttaagtacttttatgcatatggattctactgaatgcatgttgctttcataccatcataaagtcaaaatattgtaagtccaaccattataagctgggaaccatccatatttgaggtacatacccatgaatatatttatgggtttatttcttgcttcttaattctattccatttatatatatgtctgtccttatgccagtaccacaaagcattgataactgtagctttatacgaagttttgaatttgggaaatgtgagttatccagctttgttattttttaggattattttggctatttgaggtcttgcacaattacacatgaattttaagattggcttttccatttctgccaaaaaaaaaatggccattgggattttgatgcagattgtattaaatctgtagatcactttgggtagtactatcatcttaataatattgtcttccaattcatgaacacaggatatattttcacttctttatgctgtctctaatatctttcagcaatgttttgtagttttcagtgtacaagtcttttacctccttagctgaatttattcctaagtattttattctttttgatgctattttaaatagaattattttttattttgttaatttcatctcagattgttcattgctagtgtgtagaaatacaactgatttttgcacgttgatcttatatcttgcaactttgctgaattcgtttattagctctatagtgttttgtggattcttcggggttttccatacataagctcatgttcatctgagaataagatagctttacttattccttttcaatttggatgccttttatttctttttttcctaattgctctggctaagacttccaatacaattttgaatagaagcagtaaaagcaggcattcttgtctcgtttctaatgttagggaaatatctttcagtcttctaccattgagtgtgatgttagttttgggtattttatgaatgctctttatcatgttgtggattttctcttccatttctagtttgcttagtggtttttttttttttttttttttttggtcatgaaaaggtgctcagctttatcaagtgatttttctgcatcaaccagaatgaacttgcaggggtttttttccctatattttattaatgtggagttgactgggggattgattgtcttatgttgaaccagtcttgcattattgggataatttccacttgagcatgggctataacctttataacatgctgctggatttggtttgctaatattttgttgaagatttttgcacctagatgcataagggaatattatactcacatattcaattacatgcaatttgtaattttcttttcttgtgatatatttgtctggctttgatatcaagatatggtggcctcatagtatgagttgtaaagtttactctccttttctgtctcttggaagagtttaagaaggattaatgttaatccttccttaaacatttagtagaatttaccagtgaggccttctagcacaatgcctggcacataatatatggaatctaggatttgtatagtcagtcattaactatttgttgaattaataaattgtctccccaagcaggtttctaatcaaggcacaaagattgagtaacgaatgaaggcaaagccaatgtatacagggtattagttttctaatgctggggtggcaaattaccacaaacttaatatggcttaaaacaacacaagtttattatcttacagttcgatagggcagaagactgacccaagtcttactgggctaaaatcaaggtgtcatcagggctgcatttctttctggaagctctagaaaaggatcctttttcggtcgcctgtagtcccagctactcgggaggctgaggcaggagaatggcgtgaacccgggaggcggagcttgcagtgagcggagatggcgccactgcactccagcctgggcgacagagtgagactccctctcaaaaaaaaagaaaaagaaaaggatcctttttcctttcttttccagcttctagaggccacacacattcattaactcatggcttccttcctccatcttcgaagccagtaacattgcacctttgtgactattcttaagtagtcacgtctccctttgactctcctcttctgcctctctctctcactttcaaggcctcttgtgattacattgggccgacctggataatccaggatattctccctattttgacatcagctaattggcaaacttaattccatctgcaaccttaaatccctcttgccatgcaacataacacagtcaaatgttctggggattaaaatgtggacatcactgagagatcatattcttcctagcacatacggtttagtcacaagttaatgatcaacatttattagctatataatactcttaagttcaacataaactttttggatgctgataaaacggaatggcattttacattgatatatacttcatttcaaaacttcttctacttctcaatgattattctgtagcaacaaatttcttttaaatcagaaatttggaaacataacgagacctatctcaaatcaaagatgactatccccttttggagtcagactacacattcattattttagtcaaaatgagacataaaattcaggcccccaagagctgccagtacccacttacgcaggaggtagctagacgaaacaggtagctttctacaaatgattttgcaccatcccaccccagagaggtggtttggagtgtttacttattacctgggatttaattatactagctcttgcaaaagccaaatctaaaggccataaatagaaggtcaaattttctcctatatagaaaggagagcagcagagaaaacaaaatccttggtaaatctttaaacaaagttatatggtttgaatatgttattcattctattttaaccccccaatacagatatatttataaaaaagaatattgtgatttctggtataacttgtttaggaacaaagccacaaatttattaatattttctattccctgggaagaaaaaaatgctacatggcagaataattttttaaaatttccagccgggcacggtggcttatgcctgtaatcccagcactttgggaggccgaggtgggcggatcacaaggtcaggagattgagaccatcctggctaacacggtgaaacaccgtctctactaaaaatacaaaacattagctgggtgtggtggtgggcgcctgtagtcccagctactcgggaggctgaggcaagagaatggcgtgaacccgggaggcggagcttgcagtgagccgagatcgcgccacggcactccagcctgggcgacagagcgagactccgtctcaaaaaaaaaaaaaaaaaaaaaattcccatgatactaaactgatgtgtgatcatataatagacttacactgatacctattttagtgtattcaagcagataaaaaatcccaggtgttctatgagtgatatcattttcagtatttcttatgctgtatgccatggtttaaatctaggcctttcgaattggcattactaccatatttctcaaactgtattccctttctcttgaatatgttatgtaattttgtccagaacccagacatgtcaaggtgtcaaatcccacgttttggatactaacgtgtctcattaattcatacagtgggatcattcattaatgcccacattatagactctctctctctctacacacacacacacacacacacacacacacacacacactacattcttagaagatcattctgagaccagggtggaggataggctgtgcattcccagtactctttcacagctgactgtgtcctctgccagtgttttcaaactttactgcttatgaaacagctaagggtcttattaaaatttagattctgattcagtagaactgacatggtgcccaaggaactgcatctcttttaaaaaatctttatttaggtataattgacaaaagttgcatatatttaagaggtacaacttgatgttttgatatattttgtttttcatatatgatgtttgatacattgtgaaatggtcaccacaagcaagctaattaagatatatctatctctttgcctagctacctttttttgtggtgagaacatttatgacctactcttttagcaaatttcaagtatacaatattgtttactatagttactatatcgtacattagatctccagaactaatttatcttgcataattgaaattttgtaccctttgatcaacatctccctgtttcccccacaccacagtccctagcacctaagattctactgtctgcttttatgagtttgaccatcttagattccacatatgaggtcatgaagtatttttctttcagtgtctggcttattacacttagcataatattttccaggttcatccatgttatcacaagtgggaggattttcttctattttaaggccaaataatattttataattgtgggaatattccatcagatatatatatatcagattgtctttatccctccatccatcaatggacacacttaggttgtttccatatcttgactattgtgaatactgttacagtgaacatgggagtgcagatattcaacatactgattttgtatcctttggatatataacagaagtgagattgccagatcacatggtattcatttttagtttttttgaggaacctctatgctgtttttcataatggctgtaccaatttatttttgcagcaacagtgtacaaaggtttccttttctccacattaccaccaacatttgtcatcttttgtctttttgataatagctatttgctatggtttgagtgttttccccaaaaaacatgtgttggaaacttaattcccaatgcgacagtgttgggaggtagggccgaatgggagatgtttaggttatgaggactccaccctcatgaatggattaatgccgattacaaaagcacctaaggctgtgaatttgaattgctctctcttgccctctttttgcccttctgccatgttatgatatagaaagaaggcctttgccagatgctggcctcttgatcttggactgcccagcctccagaactgtgagccaaatacatttctgttcactacaaattactcagtctgtggtattctgtcatagcagcataataaattagagtccataataagttatagtccataacagactaagacactattctaatagatgtgagggaatatctcattgtgttttgatttgcatttccctgtgggttagtgatgctgagcatcatttatctgttggccttttatatttcttcttttgaaaaattctatttgggttctttgcccatttttaattgggttgtttcttactaatgagttgtttgagtttcttacccattatcagatatacagtttgcaaatattttcatccattccataggttgtcttttcactctgttgattatttcttttgctgtgcagaaagtttttagtttaatgcaatcccagtttctatttttgtttttgttgcctgtgcttttggtgtcatataaaaaaattattgcccaaatcaatatcaggtagcttttttcctgttttcttctaggagttttatagtttcaggtcttatatacaagtgtttaatcaattttgagttgaattttatgtatagtgtgagaaaagggcccaatttctttcttctgcatgtggatattcagttttcccaatatcatttattgaagagactctcttttccccgttgtgtgttcttggcacccttgtcaaaaatctgttgactgtaaatgtgtgaacttatttctgggcttttctattctgttcccttggttgatgtgtctatttttatgccagtaccatactattttgattactggagacttgtagtatattttgaaatcaggaagtatgatgcctctagctttgttcttcttgcttaagattgctttgccaggctgcatgtggtggcccacgcctgtaatcccagcactttgggaggctgaggtgggtggatcacttgaggtcagaagtttaagagcagcctggccaacatggtgaaaccccgtctctactgaaaaaatacaaaaattagccaggtgtggtagcaggcccctgtgatcccagctaatctggaggctgaggtggagaatcacttaaacctgggaggcagaggttgtagtgagccaagatcgcaccactgcactccagcctgggcaacagagcaagactctgtctcaaaaaaaaaaaaaaaagattgctttgcctccttggggtcttttgtgatttcatattaattaaaattttttttttatttctgtgaagaacaccattgagattttgatagggatcacatcaaatctatagattactttgggtagtgtggacattttaacaatactaattcttccaatctaggaatatggaatatcttttatttatctgtgtcttctttaatttccttcataaatgttttctatattttcattgtacaagtctttcatttctttggttaagtctattcctaagtattttattcttttgttgctattgtaaataagattattttctaatttcctttgggatattttatagtgtatagaaacaccactgatttctgtatgttgattttgtatcctgcaactttacagaattcatgtattagttctaacaatttttttttgagtctttagagttttctacatgtatgatcatgtcatctgcaaaaagagataattttactattctcttctatttggatgctttttattttatttattttttaaattatattttaagttctgggttacatgagcagaacatgcagttttgttacataggtatacacgtgccctggtggtttgctgcacccatcaacccgtcacctacattaggtatttctcctaatgttatccctcccctagccccccaccccccaacaggccccagcgtgtgatgttccactccctgtttccatgtgttctcattgttcagctcccacttatgagtgagaacatgcagtgtttggttttctgatcttgtgatagtttttgagaatgatggtttccagcttcatccatgtccctgcaaaggacaggaactcatccttttttatggctgtatagtattccatggtgtatatgtgctacattttcttaatccagtctatcattgatggacatttgggttggttccaagtcttcgctattgtgaatagtgccacagtaaacatacatgtgcatgtgtctttattgtagaatgatttataatcctttgggtatatgcccagtagtgggatttgctgggtcaaatggtatttctagttctagatccttgaggaatcgccatactgtcttccacaatggttgaattaatttacactcccatcaacagtgtaaaagcgttcctatttttccacaacctctccagcatctgttgtttcctgactttttaatgatcaccgttctaactggcgtgagttggtatctcattgtggttttgatttgcatttctttaatgaccagtgatgatcagcattttttcaaatgtctgttggctgcataaatgtcttcttttgagaagtgtctgttcatatcctttgcccattttttgatggggttgtttgtttttttcttgtaaatttgtttaagttctttgtagattctggatattagccctttctcagatggatagattgcaaaaattttctcccatcctgtaggttgcctgctcaccctgatgatagtttcttttgctgtgcagaagctctttagtttaattagatctcctttgtcaattttggcttttgttgccattgcttttggtgttttagacatgaagtctttgcccatgcctatctcctgaatggtattgcccaggttttcttctaggatttttatggtcctaggtcttacgtttaagtatttgatccatcttgagttgatttttgtaaaaggtgtaaggaagggatccagtttcagttttctgcatatggctagccagttttcccaacaccatttattaaatagggaatcttttccccattgcttgtttgtgtcaggtttgtcaaagatcatatggttgtaactgtgtggtgttatttctgaggcctccattctgttccattggtctgcatatctgtttggccccagtaccatgctgttttggttactgtagccttgtagtatagtttcaagtcaggtagcatgatgcctccagctttgtccttcttgtccaggattgtcttggctatgagggctctttgttggttccatatgaagtttaaagtagtgttttccaattctgtgaagaaagtcagtggtagcttgatggagatggcattgaatctataaattactttgggcagtatggccattttcatgataatgattcttcctatccatgagcatggaatgtttttccatttgtttgtgtcctctcttatttccttgatcagtggtttatagttttccttgaagaggtccttcacatctcttataagttgtattcgtaggtattttattttcttagtagcaattgtgaatgggagttcactcatgatttggctctctgtttgtctgttattggtgtataggaatgcttgtgatttttgtacattgattttgtaccctgagactttactgaagttgcttatcagcttaaggaggttttgggctgagatgatggggttttctaaatatacaatcatgtcatctgcaaagagagacaatttgacttcctcttttcctatttgaataccctttattgctttctcttgcctgattgccctggccagaacttccaatactatgttgaataggagtggtgagagagggcatccctgtcttgtgccagttttcaaagggaatgcttccagtttttgcccattcagtatgatattggctgtgcgtttgtcataaatagctcttattattttgagatatgttccaccgatacatagtttattgagagtttttagcatgaaggggtgttgaattttatcgaaggccttttctgcatctattgagataatcatgtggtttttgtcattggttctgtttatgtgatggattatgtttattgatttgcatatgttgaaccagccttgcatcccagggatgaagccaacttgattgtggtagataagctttttgatgtgctgctggatttggtttgccagtgttttattgaggatttttgtatcgatgttcatcagggatattggcctgaaattttctttttttgttgtgtctctgtcaggttttggtatcaggatgatgctggcttcataaaatgagttagggaggattccctctttttctattgtttggaatagtttcagaaggaatggtaccagctcctctttgtgcctctggtagaatttgtctgtgaatccgtctggtcctgtactttttttggttggtaggctattaattactgcctcaatttcagaacttgttataggtctattcagggattcaacttcttcctggcttagacttgggagggtgtatgtgtccaggaatttatctatttcttctagattttctagtttatctgcatagacgtgtttatagtattctctgatggtagtttgtatttctgtgggatcagtggtgatatccccaatatcattttttattgcatctatttgattcttctctcttttcctctttattagtgtggctagaagtctatctattttgttgattttttcaaaaaaaccagctcctggattcaatgattttttgaaggtttttttgtgtctctatctccttcagttctgctctgatcttagttatttcctgtcttctgctagcttttgaatttgtttgctgttgcttctctaattctttaattttgatgttagggtgtcaattttcaatttttcttgctttctcttgtgggcatttagtgctgtaaatttccctctaaacactgctttaagtgtgtcccagaaattctggtacgctgtgtcttcattctcattggtttcaaagaacatctttatatctgccttcatttcattatttacccagtagtcattcaggagcaggttgttcagtttccatgtatttttgtggttttgagtgtgtttcttaatcctgagttctaatttgattgcactgtggtctgagagactgtttgttatgatttccattcttttgtatttgctgaggagtgttttacttcgaattatgtaatcagttttagaataagtgtaatgtggtgctgagaagaatgtataatctgttgatttggggtggagagttctgtagatctctattaggtctgcttggtccagagctgagttcaagtcctgaatatccttgttaattttctgtctcattaatctaatattgacagtggggtgttaaagtatcccactattattgtgtgggagtctacgtctctttgtatgtctctaagaacttgctttatgaatctgggtgctcctgtattgggtgcatatgtatttaggatagttagctcttcttgctgcatttttccctttaccattatgtgatgctcttctttgtctcttttggtctttgttggtttaaagtctgttttatcagagattaggattgcaactcttgcttttttttttgctttccatttgcttggtaaatattcctccatccctttattttgagcctatgtgtgtctttgcaagtgagatgagtctcctgaatacagcatactgatgggtcttgactctttatccaatttgccagtctgtgtcttttaattggggtatttagcccatttacatttaaggttaatattgttatgtgtgaatttgatcctgtcattatgatgctagctggttgttttgcccattagttaatgcagtttcttcatagtgtcaatgttctttacaatttggtatgtttttgcagtggctagtaccagttgttcctttccatgtttagtgcttctttcaggagctcttgtaaggcaggtctgatggtgacaaaatccctcagcattcggttgtctgtaaagaatttcatttctccttcacttatgaagctttaagaggtttaattgactcacagttctgcatggctgtcccataagtcccatgttctttcctcaggaaacctacagtcatagcagaaagggaaataggcacatcttacatggcagcaggcaagagagagtgtgtgaaggaggaactgtcaaacacttataaaaccatcagctctcataagaactcactatcaggagaacagcgtgggggaaaccatccccatgatccaatcacctcccactaggtccctcccttgacatgtgggcattatggggattacgattcaaggtgagatttgagtgggaacatagagccaaaccatatcagtatctaaaaggaaaaaccttcagtttttccacatttggttatgatatcagctgtgagcttttcctatatggtctttattgtgttaagttccttctgtatctatcttgctgaaagtttttattatgaatggatatctagttttgtcaaattctttttctgtattgatcgaaataatcatgtgtttttcatctttcattctgataatgtggtatatcacattgattgatttgcccatgttgaaccatccttgcatcctagggataaataccacttgttcatgatgaatgatccttttaatgtgctgttgaatttggttggctggtgttttgttgaggatttttgtatccgtgttcatcagggatattggcctgtagttttctttcttttcttttcattttctttttctttctttttttttttttttttttttgagacagagtcttgctctgtcacccaggctggagtgcagtggtggtatgatcttggctcactacaacctccacctcctggattcaagcgattctcctgcctcagcctcctgagtagctgggactactggaacatgccatcacacccagctaatttttgtatttttttagtagagatgagttttcaccttgttggccaggctggtctcgaattcctgacctcaagtgatttgcctgcttcagcctcccaaagtgttgggattacaggcttgagccaccacacctggcctggcctgtagttttcttttctagtgttgtttttgcctggatatggtatcagggtgatgttggctaataaattgtattttgaagtgttctctcttgtattttttggaagagtttaagaaatactggtattaatacttcgttgaatgtttgatggaattcatccatgaagccattggtcctgggcttttctttgttggaaggtttttgattactagatttaatatccctatttgttgttagtctgttaaggctttctatttctttgttattcagttttggtatgttatatgtttctaggaatttatccatttcctctaggttaaccaatttgttgacacttataatagtcccttatggttctgtctgtttctgtgacatcagttgtagtgtctcctctttcatttatattttatttatatgagtcttctctctttttttcgtagtctagataaggacttgtcaattttgtttattttttcaaaaaaatcaactcttagttttgtcagttatttccaattgtttttttattctcttttttatttatttctgctctagcatttattatctcctttgttctgctacctttgggcttagttttttttttcttctttttgtagttcctggaggtgataagttgggttgtttatttcatatgtttcttctttttaaatataggcatttattgctataaatttccctattagtatgcttttactgcatcctttaagttttggtatattatcaagattttggtttcttctgtgacccaatggtcgttcaagaatgtgttgtttagtttccacatatttgtgaattttcgtgttttcttattgttattgatttgtagtttcaatccattgtggtcagaaaatatacttggtatgatattaatcttcttaaatttattatgacttgttttgtgacctgaaaggtgatctgtcctgaagaatgttttgtgtgtgcttgataattctactgttgggtggaaagttctgtatatacattttaggtccattgggtctattttattcttcagttctgttttgtccttattgattttctgttgggatgatctattcattatagagagtggagtattgaagtcaactatattatattgttatctatttctccttccatgtctgtcaatgtttgctttatatatttaggtactttcgtgttgggtacatatatatttataattattacatcttcctgttcaagtgacccttttattatataatgaccttctatgtctcatgtcacagttttttacttaaagactattttttctcatacaagtatagccacccctgctctcttttggttacagtttgcatggcataactttctccaccccttcactttcagcctatgtatgtccttaaatcaaaagtgagtctgttatcaacaacatgtagttgggtcctgtttatttttgtttcttacttcccatctctgaattgttggctttttaaaaagcccattcagttactctgtgtcttttgactggggagtttagtcaatttacacttaaagtaattattgataggttaggactttctgttgccattctgttaatagttttctgttttgtagttttcttgttcctttcctctttttctttctttgtggtttgatgatttttgcttggatgtgttttgattcttttctctttatcttctgtatatctactgtgtgggggggcggtcgggggggttaccacagggatcaaattgaacactttatagttatggcagtctgttttaagctgacaacaccttcaatcacatacagaaactctatactttactcattccccccgccacaactttatgtaatcgacgtcatattttacttccttctatattgtgtttccattgacaaatttctgtcactatagttactattactatttttgtcttttaatttataaattaatattaatagtgatttataacaatcattatagtgttacaatagtctatgtttctctttatatttacctttagcagtgaaaggattcatatgcttttgtgttactgttttttttttatttcaacttgaagaactattagcacttcttataaggcaggtctcatggtgacaaaccccctcagtttttgtttgagaaaggctttatctttgtgttcattcttaaaggacagtttttccagataaagtattgttgattggatttttttctctcagtactttgaatatatcatcccactctttcctgacctgcaaggtttctgctgagatatccactcatagtcttatggagctcccctataggtgacaattcactttcttcttactaccccaaaattctcttttgtctttgttgaaaatttaattataatgcatctcactgtagacttctgtgggtttaatgtatttggttatctttgggcttaatgaatccagatggcacttcccctccatagatttggggagttctcacctattatttctttaaataagtttcctttctctctctcttctccttttaagatttctataatgcatctatcattttgcttgatgatgtcccataagtcctctgttcttccttcactctttctcattgttctttttattccgctaactagataatttcaaatgacttgtcttcaagtttacaaattctttcttctgaatgattgagtctgctattaaagatcgctattaaattttttagttcagtcattcttcagctatattcagcaatattctttagctacaggatttttatttggttcttttttatggtttttatttctttattaaacttctaatgttgttcatgtattgttttcctcattttgttagtcgtcttcctgtatcctcttgtagctaattgagcttctttaaatgattattttgaattctttgtcaaaaatttcatgaatctccatttcttcagggttggttactggagctttattagttccctttggtgatgtcatatttgcctgattcttcatgatccacatagcctagcattggtatctgtgcattggagtgagctgacacctcttctggtctgaagttgggtactcagacaatgggcccattaccagggctttggataggtgtagctctcactgggtccttgagtgggcaggactgcctgcagaccatgatgcagtgggcctggagctgggtcaaagggctgcttcagggtccccacttgggcccacagtcagtgggcctgttatgggggcacaggtaagtgtggattcaggcaggactgtctccagaacatggtacagcaagactggagttggctcacagggttacttctgagtccacagtcaggtctagttggtgggcctgcttccagaggtggactggcatgactcccacctgtttcctaagtaggcaaaacttccccaagaccatggtagtgtggtactgaagctgctttaggtacagggctgcttcagagtccacagttgggagccctgttactggggttgccaatgggagttgctcctcccagattcctgggcagatagggatagtggtaggaccacatacaaacaactctggagctaagtccccagggtggtgggctgcttctgggtccacaaccagaactacagttgacaggcctgccgctagaatgtgggcctgccttattaaagtattcatctttgttcttgagctctaccagggtttctcaacctcctacctgaatcccaaggctcccacaaagacacttttgtccatagatcattgtcaaattattgttcctgtgggggaacaagagctagggacctcctatcccatcaactcactgataccgttctcctgatgctgcattttgaattgccctcaggtgatgctgctactcctggtctgtggaccatgctggagtagcagagcccaaatggcttcctcaacttttatgagccttttacaggaactcaaagtagaaaataacttcacttgccccagacctaataatttcctttgttcccacttcttcttggtgctttcctcctttgtgtctaccatcgtaacatccatctaaccatagttgtcttatgtagatgttggatgctgttgagaaacgcacaaagcaaattagaaggaagatatgattgacagaaattgctttttactctgtattcactttccatgtatttgtgctaatctctccatacaggtcttctttggcaatgtggattcatctgggataaaacacaatatttttaaccctccaattattgctcgatacatccgtttgcacccaactcattatagcattcgcagcactcttcgcatggagttgatgggctgtgatttaaatagtaagtgccaagtcatcccatatccttcttccctcaaccatgggtagggtgactaactgttctagttatcctgagactgggggaggggttcccggtatcaggacacaaaattgtcagtgctaaaaccagcatagtcctgggcaaacccagaaataccattcaacccagcagtcccatcactgggtatataatcaaaggaatataaatcattctgtcataaagacacatgcacgcatatgttcatttcagcactattcacaatagcaaaggcatggagtcaacctaaatgcccatcaacaacagattggataaagaaaatgtggtacatacataccatggaatactatgcagccataaaaaagaatgagatcatgtccttttcagcaacatagatgcagctagaggccattatcataaatgaactaatgcaggaacagaaaaccaaatatcatgtgttctcataagtgggagctaaacattaaatgcacatggacacaatgatggacactcaggaggggagaggttgggaggggggtgtgggttagaaggttatgtattgtgtactgcactcactacctgagtgaggggatcattcatacaccaagcctcagtgacatgcaatttacccatgcaacaaacctacccatgtacccctagaatctaaaataaaagtagaagaagaaaagaaacaaagaaaattaaagagtcacacaaagtgggaagagctggctggaaaacagatagcaataacagaattggccgggcgtggtggctcacacctgtaatcccagcactttgtgaggccaaggcgggtggatcacgaggtcaggagatcaagaccatcctggctaacatagtgaaaccccaactctactaaaaatacaaaaaattagccgggtgtggtggtgtgcgcctgtagtcccagctactcgggaggctgaggcaagagaatcgcttgaactcgggaggcagaggttgcagtgagctgagatcatgccactacactccagcctgggtgacaaagcgagactccatctcaaaaaaacaaaaacaaaacaaaacaaaacaaaaaaccaataacagaatctgtgcaaaagttaaaacctgagaaatgatattatgatgacagtagccctagaatatcagtggaagctgctcagtataactgaggctgaagcatgtccttgtgataaccttcttttttcttttctttgaggttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtaagaggcaacagatttactgtttaactgactcagagcagtggttggggaaaaaatcggggaaggccttgactgtttcttctgaggtatttctgtcaactgttagttctaaaaagtgtgtcaaggaagtttggttatgggcagacaaccacacaggcatttgggggaaatgatctctaattgaacctcctggaagaagaatctctatatctagtactgagctaatatctgtcaaagaattgtagaagctaaagtccattttacagataaatatcaacaattagctttctttccaggtttctcattacatcaatgaaaagtaaacatttactgcacatcttagtatccctaggatgagcctagggatacaaaggtgaattgtgaaaaattttggccctgaagttgcttagagttgaataagagagactgactagccaatagaaagtggaggctgggtgcggtggctcatgcctgtaatcccagcactttgggaggctgaggcgggccgatcacaaggtcaggagttctagatcactcttttgctgaggcaggataatcgcatgaacctgggaggcggaggttgcagtgagctgagatcatgctattgcactccagcccaggcaacagtgcctgactctgtctgaaagaggcagagagagagagagagagaaagaaaggaaagaaggaaggaagaaaaagaaagaaaggaaggaaggaaggaggccgggcagagtggctcacgcctgtaatcctagcactttgggaggcctaggtggcagatcacctgaagtcaggagttcaagaccagcctggccaacctggtgaaacctcatctctactaaaaatataaaattatctggacatggtggtgggcacctgtaaccacagctactcgggaagctgaggcaggagaatcggttgaactcgggaggcagaggttcagtgagctgagatcatgccattgcactacagcctgggtgacagagcaagactccgtctcaaaaaagaaagtagagtgagaagtgctgtggtatggttaagagggatttgggaatttctgggagtaaatggtgaccaagaggctactagtccaactctattgccctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtaagctggtctccttggaaagaaagaaagaaagaaaaaaaataccacctctcctagagcttaacataacataaaaaggttgatatatgaccaaattttcagagcaaaatttattaagtacctatggtagcaagacattgtaaaaggcattctgagagaacacagtgactttaagaaaaaggtaaaatactgagaaaagggcagagtagatccaagagttaattctcctcatcagcaccttgattcccaagcctttttgacctttaagtttagtggtccaggaagtcttcattcttaatctgggtttgctggataattcaacaaattgtcctgattaaaagacatgacataaagtcttatcaccccatgagtaatgggggaaggaatagttcctctctttggtattttttatattcttttttcaccaagaattaaccatgatgtggtccttaccaatctctctaatacagtctcttgccacttggctctttaagctccatccatactaagaaattctcaggtcactaaatacagccattatatctcataccaggcttttaaatagatactatttcttctacctggaacatttttctagctaccctctactgccactttcacctgactcattcgttaagtctcaggtaaacatcatgtccaagaagaattcccttatccatcaaggctggatgaaagacttcaccaaactggcagtttggtgaactgaagtctagacattggatattctagaagaaaaattcccatttaaaaaaggttatatctctgattagtgccacaacatgatgaactttcaaaatatgctaagtgaaggccgggcgcggtggctgatgcctgtaatcccagcactttgggaggctgaggcaggcagatcacgaggtcggtaaattgagaccatcctggctaacacagtgaaaccccatctctactaaaaatacaaaaaattagccaagcgtggtggcgggtgcctgtagtcccagctactcgggaggctgagacaggagaatggcatgaacccgggaggcagagcttgcagtgagccgagatcgcaccactgcattccaacctgggcaacagagtgagactccatctcaaaaaaaaaaaaaaaagaaaatacgctaagtgaataggccagacataaaaggatagatattatatgattctacttatatgagtgtgttagtcagggatatccaaagaaatagaaccaataggagattctgtctgtctgtctctctctctctgtctctctggatgagctaaactgttttagttcaagactgaaagcaggaaaaagctgatgttccagtccaaaggcagacaggcagcaagaatactttcttacttggggaagactcagtctttttgttctattcaggccttcaactaattggatgatgcctcccacattagggagagcaatctgctttactcagtctactgacttcgatgttaatcccattcaaaaacaccttcacagaaataaccagaataatgtttgagtaaatatctgggcaccttatgaccaagtaaagtagatacataaaattaaccatgacaagtccaccccttgtcaatgtagcacccatcatacacatctcctttatctctaagtagagacaaaaatgaggtcataattccacctaacatgatataacaaaacttggctggtattgataactaccttcttctactacccattctgtattgactttgccttcagcaagcatctcagctgattgtggttctttacctgatgaggtgacccaaacctttattcctgaagagcctgggccactagtagtcctgcatggattgggttgctgtagtttcccattgaccagaatcatagggcctggtaatactaagagacactctaagggatctattgtattccagacacactcttccatacctccattgtgaagcagtagttcagtttccttccaggaaggacaaaacgctgccccttccatgatgaacatattccaatgtaatcaacctgctgccagatagctggctgatcatcctgggaaatactgccatactgaggactctgtgtttgtctctactgctggcagattgggcacttagcagtggccatagccaggtcagccttgttgaatagaagtccatgttgctgagcccatgcatagcctctatccctgccaccatggctactttgttcatgagcccatcaggcagtgacataggtggctgagtaaaaaggatgactggtatccacagaacaggtcatcatatctactttttttttgagatggagtcttgctctgttgcccaggctggagtgcagtggcacaatctcagctcactgcaacctctgcctcccaggttcaagcatttctcgtgcctcagcctcccgagtagctgggactacaggcacgcatcaccatgcctggctaatttttgtatttttagtagagacagggtttcaccatgttggccaggctggtcttgaactcctgacttcaggtgatcctcccgccttggcttcccaaagtgctgggattacaggcgtgagccactgcacccggcccatcatatttacttgattattgaaatccttatctgctgaggtcacccttcgttgagcactcacatgggacataaatatattcacatcctttgcccattcagagagatctgtccacatacctcttccccaaatttctttgtcacctgttttctaatcatgttccttccaagtccctatctggacaaagcactgactacagcccattacttgacatataattgcacacctggccatttctccttctaagcaaagtccacaaccaggtacactgcctaaaattctgcccactgtccttcatgggtatctcagatcgggactgtccacttttgtgtagtacctgcatatcgtgcagaaccgtctgtaaaccaggcccaagactcctcttcctctgtaaactgatcatagggaactcccaatggggccataagtgcaggctgggagagagaaggcagggtagcagaaacaggcaccatggacatttgggctacttcttcatgtaatttacatgtgttttcagtacctgctcagacatgatcatgtatataccacttccatttgatgatggagtgccattgttcatacccaactttatggcttggtgggtcagataacacctagttcatgatgggcagttcaggtcacatggcaacttggtggtctgtggctaagcattcagtatctactaaggcccagtagtaggccaagagctatctcacaaaaggagaacagttattcacagaggattacaggaggatttctcactacagtagcccctgctccataggtcagggaaccaatgtgaagatcctgctagctgctcaatatatctgttccaattacgcattccaggactggggaaataaccacaagatagtctcacagatcctctgcatccactttgagatggacttgagctaaaattccattgatcatttgaccctccataagcccatactctgactggtggaccacagtgacattttgggtctcctgaaattagtgccagttcagagccattgtccagtagtccctgaaaggtctgattaattatttttcttcagtgcacatttattctgatagaaaggccatatgtccctttggggaaggctgagagaaagagtggcagtattcttggcagtgtaccagagtccttcctcaaggagactgagcctccccttcattcaaggagtgctgggtctgtaaacctgctcaagtctgggaattgattgagaggccgtgactctgtttttattattcaggttagacttttgttcacttgacctagaacttttccacttatgcagttcaagaatttggtaggcattctatctatatcacatctaggaacactataatctactagccaacaccataggtctgtgcaagtcatactattctaactgctgctttgactctgctgtcccttatggtaaccacacttaccttgcctttggcagttgagtgctgcccattggccccttccaccccaggatccaattattcccattgtatttaggttttctaattcagtgactgcaggtcctgctgtaaggtgtcacctacagagaagagtgatcacagagcccttcaaggatgctgaggttcccctcacaaatttattcctcaaagtaatagtgagatctgtgtcttctgaactctcccagtgttggtgagtatgtcttaaatgacaaattcactctagcatttcaatctcctttcttctacattaaaccagggcaagtctgaaatttctagtttgctcactgtgggccatcttttggtctgtgtttcagccaaccaattaaactgttagaggccttcctaattccctgagatgcaacattaagtccagaatctctgcttagtgggcccatgtcaataaatttggcctaatccaactttacgtgccttccaccgttatctcacatccttagtacccattcctatacatattctctggattcctgcttgtgtaaattagaaaactcaagtcatgattttggagtgtagtgcaccttgtcatgggtcaccttcatacctcacctcgcctgctgggacttgagtgtagttatagatctaataacaaagaggggtggtagggtgggtcctgaaggaatcagcattatcttgcatggcagttgcctcaggggaagccattacagtttcctcaggcagtgcagggttaatccacttagactggagtagagatactgccaccacagggctggagagaaaactttcactgacaaagaagactcatcaatatttaggagctcaatgtccccagcttaatcagggtcttccacacatacctaatccaacttgtagtgccccattctttcccaatcactgcccttgctttaacagtagacaccctgcaaagctgggagtttggcttgctttgtaattcagttagtcacaggatgagatttggcatttgattttcagcaatctcagctctgtggctacagtagataagggtctccttcagggcatacatagaatctgtcaagtcatttatgcagctcttgagctgggaattcaaattcctgagctcctccttttctttcatcactttttccagcaacattaggagcaaccgactaatcccatcatattcattagtttgacaaatatgttcacaagtgtcaatatacatagtcaccaagacccttgcttcttaaaagtagttgattaggagtatccaatggagatattttgcatatacatattttttgagatggagtctcgctctgtcacccaggccggagtgcagtggcatgatctcagctcactgcaacctccatctcccaggttcaagcgattatcatgcctcagcctcccgagtagttgggattacaggcacctgcctaatttttgtgtttttagtagagacagggtttcatcatgttggccaggctggtctcgaactcctgacctcaggtgatccatccacctcggcctcccaaagtgctgggattacaggcgtgagccaccgcgcccagcctggcctacatatttctattgccagatcatgccatggacaatttttactactgaaaatagtcattagtgtctttaaatttcatcaggttacagaaccaattccagaaatccaataacaaatttataaaatttatccttaaaattctgttcctttagaatcactcttggtgtgaaaatctgtattagtcatggttcccaaagaaacaaaaccagaaccaagaggagatacatacacacacacacacacacacacacacacaaggaattagctcatgtgattatggagtctgccaagtctcaagatctgcagggtgagttggcagcctagagaccccagagagctgattcgtagttccagttcaaagaccagcaggctacagacccagaaagagttaaaatgttttagttcgagcccaaaggcaggaaaaaaactgaagtcccagtttaaaggtagtcaaatagaaggaactgtctcttactaagaggacagtaagcctttttgttatatttaggccttcaactgattggataagttctacccacactggggagaacaatctgctttacttagtctaccaattcaaatgttaatctcaccaaaaaacactctcacagacacacataaaataaagtttaatcaaatatatgggcaccccatggcccagtcaagttgacacataaaattaaccaccataatgaggtatctagagcaggcaaattcataaagacagaaagtagaaaagaggttaccagggtcttggaatggggaagaaatggagagttatttttaatgagtacagagtttctgtttggggtgatgaaaaagttctggaaatggatagtggtaatgggtgcacaatattgtgagtatacttaataccactaaattgtacacttaaaaatgattaaaatggtaaattttatgtatattgtacaacaataaaaaaggctatatcactgacaatgcattgttgtatttagcaaagaaaggggaatctccagcctccccatcaacaaaaacccccacaaacttctattttaaaataatgagctgaaatcatagcggagaggtgaataatgagcaaatataaaaaggaagacctttcctcagacagaatgcccatattaatgttgttactggaagactaagccttgagcaaaatgcaaggagaactcagtgtgagaattctgcattgtcatgaatcccagaaggaagctagagaagttgcagataaatattatcctctggcacctggaagaaccattctcaacctactctagaaaaaaagcacctccagtttaggcctccaggattcctacatattaaaattataagatcacagacatagatcagcaaacatgcaagacaacaagacaacttgagtacaagtgaacagaaacaatcaattcagatttaaaacttgaagaacaccagatattgacattatcggatacataatatgaaataattatgtataaaatctttaaagtaataacatatggaaacatgaaaataaaagacaaattatccaacattattaggcagttgaaaaaaaccattgcaggttacaaagtcaacatgcaaaaatcaattgtatttttatatactaacaattacaaatatgaaaaggaaaacagaaaagtctatttacaatagcatcaaagataatacaatatttaggaataaatttaacgaaggaggtgcaagtcttgtccactaaaaacaaaaaaacccagttgaaagaaactaaagaactgtctggtctgaagacagcaaatatggaaaattagcaactagaaaaaaattaaaaattaaaaattaaaagagaaattaaataactaaataaatgaaaaggcatcctggatttatggatttgaagacataatattcttaagataagaatattaccacaaaccatttgcagattcaaagcaagcattctgggtttttttgtttgtttgtttgttttttgatttgagacggagtctcactctgtcgctcaggctgcagtgtggtggtgcaatctccactcaccataacctctgcttcctgggctcaagcgattctccggcctcaaagcattctctatcagaatcccaaagacatttttttttttgaggaatagaaaaatctatcctaaaattcagatggaatttcaagggaccctgaatagccaaaacaatcttgaaaaagaacaacgttggaggagtcatacttcccaatttcagaacttactacaaagctacaagaatcaaaacagggcagtacttacataaatatagacacatagatcaatggaatagaattgagagtccagaaataagcctatacatctatggtcaattgattttcaataaaagtgccaagaccattttgtgggaaaagaatagtctcttcaacaaatggtgctgggacaattggatatccacatgcaaaagaatgaagttggatctttaccatatacaaaatttaactcaaggctggatgtggtggctcacatctgtaatcccagcactttgggaggctaaggctggtggatcacttgagctcaggagtttgagaccagcctgggcaacacagtgagactctgtatctacaaaacaagaaaaaaaaattagctggcatgatggtacacacctgtagtcccagctactagggaagctgggataggaggatcgcttgagcccaggaggtggaggctgcagtgagccatgatcgcaccactgcactccagcctgggtgtcagagcaagaccctgtctgtaaaaaatcatttaactaaaaatgtatcaaaaaactaaatataaaagctaaaaccataaaactgtaagaaaaaacaaagaggtaaattgttatgatactggatttggcaatggtttcttagatgtgacaccacaatcacaagcaacaactctataaaaatatatatagtaggcatctttaaagttaaaagcttttgtacatcaaagaacactatcaagaaagtaaaaagatgatctacagtataggagaaaaaaattgcaaatcatatatctgataaagggcctagtatcccagaatataaaaagaactcttacaactcaacaacagaaagacaaccaaattttaaaatgggtaaaggacttcaatggaacttctccaaagaagatatacaaggatccaacaaactcatgaaaagatagacaacatcattagttattagggaaatgcaaatcaaaaccacaatgagatagcatttcaaacctgctaggatggctaaattaaaaaaaaaacaaaaacaaaatgtcaagcgggaaaataacaagtgttagcaagaatataaagaaattggaaccttccttgatgatgagaatgtgaaatagggcagccactgtagaaaatattttggcagttcctcagtaaggaaaacatagaattaacatagacccagcaattctactcctgggtgtggacccaaaagaattaaaagcaggcactctaacaaaaactaatatacaaatgcatatagaagtactattcataatagcaaacaggtgaaaacaattcaaatgttcatcaagtgatgaacagataaacaaaatgtggtctatccatatatggactattatttattcataaaaaatcaaagtactgatccatgctaaaacatggatgctccttgaaagcattatgctaagtgaaagcagccaggcacaaaaggccacattccacttatatgaaatacccagaatagcaaatccatagagacagaaaacagattagtggttgccagaagctggcagaaggagtgaatgtggagtggcttcttaataagtattgaatctccttttggggttatagaaatgttctggaactagatagtggtgatggctatataacattgtgaatgtactaaatggcactgaacttcacactttaaaattgttaaaatggtaaattttatgtttgcgaattttgcaatagataagtcagaagacatgtacattaccataatgagtaacaaactgacagctgatttctaaataatagcaaatatcagaaaataatgaatgatgtcttcacaatgctaaaataaacaatgtgaacccctctctcaaaaagaaaacctaatgaaaatatcttttatgcgttaaagcaaaagaggaaattaggacacagacaggcacagagggacgaccacatgaagatatagaaagaggacagacacctacaagccaacgagagaggccttacaagaaaccaacccttagccaggtgtggtagtgtgcacttgtagttcttgttacaagggtgcagtgagctagggttgtgccactgcactccagcctgggaaacagaacaagaccctgcctctaaaaaaaaaaataaagagaaggagaagaagaagaaaaggaaaagaaaaaaaaaaagaaccaagcctgctggccaggcgtggtaactcatgcctgtaatcccagcactttggaaggctgaggcaggaagatcatctgaggtcaggagttcaagaccagcctgcccaacatggtgaaacccccctctactaaaaatacaaaaattagctggacatgctggcatgcgcttgtaatcccagctactcgggaggctgaggcacaagaattgcttgagcccaggaggcagaagttgcagtgagcccagatcgcgccatcacattccagcctggactacagagggagactccatctcaaaaaacaaacagacaaaaaaaaaatacacacacacacacacacacacacacacacacacacaaaacaagcctgcctaccccttgatcttggacttgtagcctccagaactgtgagaaaataaatttctattgtttaagccaggtgtgcgtgtgaaaatttagaacatatgacaacagcaaaaaagtcagcatgtggataaatagaataaaggattctaaaatccatgtattatctaggaggtaaagatgttaatattaaaccttcataatttgattaatgttgtagtttataggatagccagtaagtaatagaaatacacacaatgtaagactcccaaaatggtagaagaaaaaatatgaaaggataaaatatactcaacaaacctaaatgaaagcaagcaaagagagataaagaaacataaaacaggtaggaaaaatagcaagataagatggtatatttaaattgaaatataacagtaatcatatgtaatatgaatggaccaaatatttcagttaaaagacaaagattgtcagattgataaaaaagcaaaagtagctgggtgtgatggctcacacctgtagtcccagctacttaggatgctgatgtgggaggatcacttgagcccaggaggttcagcctggacaagatagtgagacttgtctctttaaaaaaaaaaaaaaaaagcaaaagtaaattgtgtgcattttatgagtcatatctaaaacattagatacagaaaagtagcaagacaaaaatgggaaaagaaattatgcaaatatctaaaagatatcgattacagctctattgatagcagaaaaatagactttaaagcaagaaagtattgctgaagattaagaatgtgatttcatggctggacgcggtggctcacacctgtaatcccagcactttgggaggccgaggcaggtggatcatgaggtcaggaaattgagaccatcctggctaacatggtgaaaccccgtctctactaaaaaaaaatacaaaaattagccgggtgtggtggcggacacctgtagtcccagttactcaggagggtgaggcaggagaatggcgtgaactcgggaggctagattttaacacatctctcgtcaattgatggaacaatgtatagaaatagaacaattaacatgattcacaagtttgatcttatagacatatttagaaaatagcaccttgaaattgcaaaattacaagggtggttccaacatggccgaataggaacagctccagtctacagctcccagcatgaatgacacagaagacaggtgatttctgcatttccaactaaggtaccaggttaatctcactgtggcttgtcggacagtgggtgcaggacagtgggtgcagcccaccgagcatgagccgaagcagggtaaggtatcacctcacccgggaagcacaaggggtcagggaattccctttcctagccaagggaagctgtgacagatggcacctggaaaattgggtcactcccatcctaatactgcgcttttccaatggtcttagcaaacggcacaccaggagattatatcctgcacctggctcagagggtcccacacccacggagcctcgctcattgctagcacagcagtctgagatcaaactgcaaggtggctgcaaggcagggagaggggcacccgccattgctgaggcttgagtaggtaaacaaagcggccaggaagctcgaacttggtggagcccaccgcagctcaaggaggcctgcctgcctctgtacgctccacctttgggggcagggcaaagacaaacaaaaagacagcagtaacctctgcagacttaaatgtccctgtctgacagctttgaagagagtagtggttctcccagcacagagtttgtgatctgagaacggacagactgcctcctcaagtgggtccctgacccccgagtagcctaactgggaggcacgccccagtaggggcagactgacacctcacacagctgggtacccctctgagaccaagcttccagaggaacgatcaggcagcaacatttgctgttcagcaatattcgctcttctgcagcctctgctgctgatacccaggcaaacagggtctggagcggacctccagcaaactccaacagacctgcagctgagggtcctgtctgttagaaggaaaactaacaaacagaaaggacatccacaccaaaaccccatctgtacatcaccatcatcaaagaccaaaggtagataaaaccacaaagatggggaaaaaacagagcagaaaagctgaaaattctaaaaatcagagtacctctcctactccaaaggaacgcagctcctcgccagcaacggaacaaagctggacagaaaatgactttgacgagttgagagaagaaggcttcagatgatcaaacttctctgagctaaaggaggaagttcgaacccatcacaaagaagctaaaaaccttgaaaaaaaaggttagatgaatggctaactagaataaccagtatagagaagtccttaaatgacctgatggagctgaaaaccatggcacgagaactatgtgacgaatgcataagctttagtagccgatgcgatcaactggaagaaagggtatcagtgattgaagatcaaatgaatgaaatgaagcgagaagagaagtttagagaaaaaagaataaaaagaaatgaacaaagcctccaagaaatatgggactatgtgaaaagaccaaatctatgtctgattagtgtacctgaaagtgacagggagaatggaaccaagttggaaaacactctgcaggatattatccaggagaacttccccaacctagcaaggcaggccaacattcaaattcaggaaatacagagaacgccacaaagatactccttgagaagagcaactccaagacacataactgtcagattcaccaaagttgaaatgaaggaaaaaatgttaagggcagccagacagaaagttcgggttacccgcaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcttgccctacaagagctcctgaaggaagcactaaacatagaaaggaacaaccggtaccagccactgcaaaaacatcccaaattgtaaagaccatcgatgctaggaagaaactgcatcaactaatgagcaaaataaccagctaacatcataatgacaggatcaaattcacacataacaatattaaccttaaacataaatgggctaactgctccaattaaaagacacagactggcacattggataaagagtcaagacccatcagtgtgctgtattcaggagacccatctcacatgcagagactcacataggctcgaaataaagggatggaggaagatctaccaagcaaatggaaaacaaaaaaagaaaagcaggggttgcaatcctagtctctgataaaacagactttaaaccaacaaagatcaaaagagacaaggccattacataatggtaaagggatcaattcaacaagaagagctaactatccaaaatatatatgcacccaatacaggagcacccagattcataaagcaagtccttagagacctacaaagagacttagactcccacacaataataatgggagactttaacaccccactgtcaacattagacagttcaacgagacagaaagttaacaaggatatccaggaattgaactcagctctgcagcaagcggacctaatagacatctacagaactctccatcccaaatcaacagaatatacattcttctcagcaccacatccaaaactgaccacatagttggaagtaaagcactcctcagcaaatgtaaaagaacagaaattataacaaactgtctctcaggccacagtgcaatcaaactagaactcaggattaagaaactcattcaaaaccgctcaactacatggaaactgaacaacctgctcctgaatgactactgggtacatagcgaaatgaaggcagaaataaagatgttctttgaaaccaatgagaacaaagacacaatataccagaatctctgggacacatttaaagcagtgtgtagaggaaaatttatagcactaagtgcccacaggagaaagcaggaaagatcaaaaattgacaccctaacatcacaatttaaagaactagagaagcaagagcaaacacattcaaaagctggcagaaggcaagaaataactaagatcagagcagaactgaaggagatagagacacaaaaaaccctttaaaaaatcaatgaatccaggaactggttttttgaaaagatcaacaaaattgatagaacactagcaagactaataaagaagaaaagagagaagaatcaaatagacgcaataaaaaatgataaaggggatatcaccaccaatcccacagaaatacaaactaccatcagagaatactataaacacctctatgtaaataaactagaaaatctagaagaaatggataaattcctggacacatacaccctcccaagactaaaccaggaagaagttgaatccctgaatagaccaataacaggctctgaaattgaggcaataattaatagcttaccaaccaaaaaaagtccaggaccagacggattcacactcaaattctaccagaactacaaggaggagctggtaccattccttctgaaactattccaatcaatagaaaaagatggaatcctccctaactcattttatgaggccagcatcatcctgataccaaagcctggcagagaaacaacaaaaaaagagaattttagaccaatatccctgatgaacattgatgcaaaaatcctcaataaaatactggcaaaccaaatccagcagcacatcaaaaagcttatccaccatgatcaagtgggcttcatctctgggatgcaaggctggttcaacatacgaaaatcaataaacgtaatccagcatataaacagaaccaaagacaaaaaccacatgattatctcaatagatgcagaaaaggcctttgacaaaattcaacaacacttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgttcgcagacgacatgattgtatatctagaaaacaccattgtctcagcccaaaatctccttatgctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatatgaaggacctcttcaaggagaactacaaaccactgctcaatgaaataaaaggggatacaaacaaatggaagaacattccatgctcatgggtaggaagaatcaatattgtgaaaatggccatactgcccaaggtattttatagattcaatgccatccccatcatgctaccaatgactttctttacagaattctaaaaaactattttaaagttcatttggaaccaaaaaagagcccgcattgccaagtcaatcctaagccaaaagaacaaagctggaggcatcacgctacctgacttcaaactatactacacggctacagtaaccaaaacagcatggtactggtaccaaaacagagatatagaccaatggaacagaacagagccctcagaagtaataccacacatctacaaccatctgatctttgacaaacctgacaaaaacaagaaatggggaaaggattccctattgaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattgacaaatgggatctaatgaaactaaagagcttccgcacagcaaaagaaactaccatcccagtgaacaggcgagctacaaattgggagaaaatgtttgcaatctattcatctgacaaagggctaatatccagaatctacgaagaactcaaacaaacttacaagaaaaaaagaccccatcaaaaagtgggtgaaggatataaacagacacttctcaaaagaagacatttatgcagccaacagatacatgaaaaaatgctcatcatcactggccatcagagaaatgcaaatcaaaaccacagtgagataccatctcacaccagttagaatggcgatcattaaaaagtcaggaaacaacaggtgctggagaggatgtggagaaataggaacgcttttacactgttggtgggactgtaaactagttcaacaattgtggaagacagtgtggcgattcctcaaggatctagaactagaaataccatttgacccagccatcccattactgggtatgtacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaggatctgttcatgtcctttgtagggacatggatgaagctggaaaccatcattctcaaaaactatcacaaggacaaaaaaccaaacaccgcatgttctcactcgtaggtgggaattgaacaataagaacacttggacacaggtaggggaacatcacacaccggggcctgtcatggggtgggtggacaggggagggatagcattaggagatatacctaatgtaaatgacgagttaatgggtgcagcacaccaacatggcacatgtatacatatgtaacaaacctgcacgttgtgcacatgtaccctagaacttacagtataataaaaaaaaagaaattgcaaaattacacattctttgtaagcacacaaaggaaacatgttagaattttccattttaagctacaaataagctacaaataaagtagtctcaaatttcagataatataaaacatgttttctggtcacaatacaattaaagttgatataaataagaaagataactataaaatcttcctatgttagaatcaagaactatacttttaaacccatgtgtcaaataagaaatcataaattagaaaatattttaaactgaatgataacaaggcatgacatattaaaatgtgggaatcagctaaagcaatatttagaaagaaatgtatagcgttaaaaacatatattggaagagaagaaagcctgacaattaatgagctaaggtatgtctcaagaagctagtgaaacagcaaaataaaccaaaaggaagtagaagcaaggaaataataaagatatgaagtaaatgaagtaaaaaagaaacatacaatagagagaataaagaaaaccaaaagttggttccttgaaaattgacaaacttctggcaagagcaatcaagatgaaaagaaggcacaaataatatcagaaactttaaaaaactggacatcaataaagatcccacaaaaatttctgccaatataaaaatataaaaaatgaggatacttattaatattaaatgttctttcttgttgtatttaccagggattaatccattttacctaattttccaaacttagtgttaaaaggttattaatttaaaaaatccagatccagatggctacactaactatattctaccaatttttcaaaggagaaataatattaaccttgcaaaaattctttcagaaaatggaaaaagatggaatgttattcaattatcttatgataatagcataaccttgacaaccaaaccgaacaagaacaatattagaaaggaagataataggcccgttttattcataaacataaatcccaaacaaaatattagcaatatggatccaaattggatttatgctaggaatgcaagtttggcttatacattagaaaactgatataatttatcacagtgacagactgaaggattatacatattggctgtcctaagcagtgcaataagatgagaaaaagaaggaaaatatgtaaggattgaatatgatgaaacaaactcattgtatgtggaagatatgatggcatagatagaaaatccaaaggaatttatatataaattattagaatttttaaaatttttcaagcttgctgaaaacaaaataaataccaaaattaattgtatttctgtatacctgaaacagttggaaaaatagttttaaatagcatttaaaaattccaagcaggagttgcacattcctgtcagataatggcagctgcctaaatctctccacagtcttcaaaaaccatacatacacatacacacacaattttaaattatgactaaaaccacccataacccatctatagaataaccagaagacaaaaagtactataagtttatatttacaagtagaaaataaatatataaatctagccaaccttgctccagagagaaaccctgtctcaaaaaaaaaaaaaaaaaaaaaaagaagaaagcaaatgttggaaattaactgtcctataaaaacaaaagtgaattactaaatcacaagacccacaaacctctttggtcacatctattaaataaattacacttccatttatcaacagtagagggtactcctggctaagaaacctagtaagccacccagccctcatgtctgcctgcataaatcacctcttattgctgaaacaagaaaatgtaaggaatttctaaatgaacagaaaatagcatatgaagcagatggtattaatgttcttgagtttttattccctctttccttgaaaacctcatcaactttaggcatggccgtacggctcatcttgatcaatagaatgtgattggacatgacatatataccacttccaaatagaagctttaaatgtgattttgtgtttgacacactcttttgtgcctctgctccaggctccagactttaagcctctagaacgataagtgaataaatttcttttgttttaaaggcaccaagtgtgtggtgaatttgttacagtagccctagaaatctaatactaacaaaaagaatgttagagttgaattagaagtgtcagtgagaacttaggaatttaaaaaatcatattcttagcactgttcactgagggaatctagaagtaattacactgcagtaataacgagcccatcccatgcccaaatcttggtctctaactaccattttccagtcaaaagaatctgagctccctagagaaatgactttttcaaggctggatcaaggaaactgccaggcaatcttagatgatcttggtgatcttgatgtgccagaagattaatgggatcatgtgaaaagaacacagaaactggtctgaagggcttcctgttggccagatttgagacaatttgagcatcaaaaggaataatgagggtaatggatcataactggaaaatcagtttgcaaccatcaatgtacttactattgaatacttgtaaagaactttaagggttgctaataccattggataaaagcttgttgtgaaacagaatatttgcatggtctcaaagtctcactccacagattgttaggaaagggaaagggttacctttataaatatagagattaggtggacatcttaaccaagtgatcaaacttagcatcatcaataatgggacaatctggcatcgcatgccccctgatttaatgcagtaaggattaagtctaacaaaagatgtacaaagcctccaaatacagcgtaaacatttgtaaaataatctcagaacagggaccttaatgtttctcaaaaatttttccaaatacagaactttatttctatagatgtttatggtatatttgccatgctatatacattatgctatatattctatgtgctgaagatacaacaatgaccaaggtctttgcccttgtggaactgacatttggtggcggagacagaggaaacagtcaataagcatgtaaagagataaaggaaaagatactgaatgctacaaaggaaacaaataagttgagatttagaacaaaaaagagtcctattttacaagaggaataatgaggaagacctttctaaagaggtagctcagcactttgggaggccgaggcgggtggatcacgaggtcaggagatcaagaccatcctggctaacacagtgaaaccccatctctactaaaaatacaaaaaatgagccgggcatggtggcgggcacctgtagtcccagctacttgggaggctgaggcaggagaatggcgtgaacccgggaggcggagcttgcagtgagccgagatggtgccactgcactccagcctgggcgacagagcgagactccgtctcaaaaaaaaaaaaaaaaattgaggcagaatttcgctatgttgcctaggcttgtctcaaactcctgggctcaagcaatcctcctgcctcagcctgctgagtagctgggactccaggggcatgccactatgcttagtttaagaggtggtatttaaactgagacccgaagggtaaaaaacatggataaaagaagaaacagaaggggtaagagccttccaagcagagggaatcacatatacaaaggctctcatgttaaataaaacaagagttgacattgttgagaaactgaaagatcagctcatctgcgatgcggtaaaataggaggaatgcagtgggagaacagatcagagacttgggcaggggctatattaggcagaacttggagaccagagtaagggggccaaggtgggaacagaccgattaaattggcatctcttgggggggtgggggggtggggaacttacccatgcatcattttttaaaagctccaaaggcgattccaataagcagccagggttgggaacctagggggaaaatgtagctagatgaatgaagatggcccaaacgtcttttgttctgatagctaaactctctgtaggatcacagtgttacttcacagtgcatttgccaggaaaagtctcttcccatttggaatccgaagtaaaactgacaccacacttgaagatgccaggattgttagaggaaaatgtcacccaatagctccaggaagcaggagccctactgttgctgtttaaccacttctttcccattttggtggcaagttgcctccttttacacaaactgcctcaggagatcctaaagatatcatggtgtctgtctgtccttgcaagagcatgcattatggtaggacattgccttcattctgttcctttttctccaagactcttgcttattctcaccatttggctggactttctactgtaggattacctcggaatccacacaaaacccacagggtttcagagttgccttgaattacacgttttgaacattcagatcttcattttcccaaacatccacccagttataggtgacctttgctccaaagtcctggagtagcaaggtgccttgagtcttagactcttcccacttctttctctcttctgcatcccctcctgccaaggttgcccagccacactaaattgcatgccttgctgtgttgcattcgttatcattctaaagttgtcaccaacatgtgcgaaaccagtttatctaataacgatagctaccattttctgagctcttgccatgtactcctcttgccacagcaaatgcattgacaagggagtctgctggccaaagcctgactctcatctccagatggtccaacacagatgctgtgtgtgacccaggacaaagcacttaatgtcactgaggtttgggaagtgggtgagaacactgtagatataaggcctagctagagtgaaggcctccaaagcagggtgctcttaattctagatgtcccagatgcgtaggacagagtcatctagtcatcttccagggtttaatcctggactactggaaacaactagaagtgagaaaagcgtctgtgctttgcagtgaccattgtcctgtcagacaaccaataaatgctatctttcctctttcaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggagacaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttgataatcttattttggcattcttttcccattgactatatacatctctatttctcaaatgttcatggaactagctcttttattttcctgctggtttcttcagtaatgagttaaataaaacattgacacatacaaacaaatgcctttgagaattgtgtttttacactggaaataaaaatgtgaacactgatttttaaaacaaataggggcactgaatagcaagatggacactctagaaaaccaaattagtgagttagaaaaccagattaaattgaactcagagtaaaaatgatataattcatgagagtctgaataaaataaatcagaaatggagcctcaatccaggagaacagcttatatggagagagagagactgagagagaaatgggagtttctgttcaatgggcataaagtttcagctatgctgctgggcacagtggctcatgcctgtaatcctggcactttgggaggccaaggcgggcggatcacctgaggtcgggagttcaagaccagcctagccaacatggcgaaatcccgtcgctaataaaaatataaaaattagttgggcatggtggcacatgcctgtagtcccagctacttgggaggttgaggcacaagaatcgcttgaacccgggaggcgggtggaggttgcagtgagccaagatcgtgccgttgcattccatcagcctgggcaacagagtgagactccatctcaaaaaaaaaaaagtttcagttatgcaagatgaattaagttctacagatctaatgtacaacattgtgcatatagctaacgataccatactgggcacttaaaaatttgttaagagagcagataccacgttgtgttcttactacagttttacaacaatgcaaaaatgcattgtaaacactatgtgcaaatagaatagcaaagaatgtatacagtgcccatgagcataacattctagtggacccacaatgcatcagagttcagtgagactcaaagggagaagaatgttggcaaagtcagtggggaggagaaaatgagtgtgatgaaataggcggtctcattaaacttcccttacaaaacacaagatcaaagataaaattattaagaatttcgagacagtgacatcagagcaaacgaaacatagg

SEQ ID NO: 5 - DNA, 188930 bp, Artificial Sequence
  synthetic construct
tcaccatggctacattctgatgtaaagagatatatcctatacctgggccaaatgtaaacagcctggaaaagtgttaggttaaaaacaaaacaaaataaataaatgaataaatgccaggtggttatgagtgctattgagaaaaatgaagccaagagggatatcagtgatgcaggtgggggtaaagagcttacaacataaatgtggtgttccatatttaaacctcattcaacagggaagattggagctgaaatgtgaaggagttgtgggagtggaactacgtggaaatctgggggaaaggtgttttgggtaaaagaaatagcaagtgttgaggtccaggggcatgagtgtgcttgatattttagggaagagtaaggagaccagtataaccagagtgagatgagactacagaggtcaggagaaagggcatgcagaccatgtgggatgctctaggacctaggccatggtaaagatgtagggttttaccctgatggaggtcagaagccattggaggattctgagaagaggagtgacaggactcgctttatagttttaaattataactataaattatagtttttaaaacaatagttgcctaacctcatgttatatgtaaaactacagttttaaaaactataaattcctcatactggcagcagtgtgaggggcaagggcaaaagcagagagactaacaggttgctggttactcttgctagtgcaagtgaattctagaatcttcgacaacatccagaacttctcttgctgctgccactcaggaagagggttggagtaggctaggaataggagcacaaattaaagctcctgttcactttgacttctccatccctctcctcctttccttaaaggttctgattaaagcagacttatgcccctactgctctcagaagtgaatgggttaagtttagcagcctcccttttgctacttcagttcttcctgtggctgcttcccactgataaaaaggaagcaatcctatcggttactgcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaaggtaaaggcatgtcctgtagggtctgatcggggccaggattgtggggatgtaagtctgcttggaggaaggtgcagacatcgggttaggatggttgtgatgctacctgggccccaaagaaacatttctgggtaaggtgtgcacacatctgtgttattagcagaaatgctaactgccaattcttttcataggtctgacctatttgttgatattttgttctgttttgtccattgcttctcttcgtcatatgctgctcctccagaatctagagactggagtagagggagggtgaagggacaaagacaaaacttccctctgcctgcccaagcttccatagagagaatcaaggcaatgaaatccaatcaatatcacacacaagtttcatgtctggttctcttgtgtgtacatgcaatgtgtgtttttataatatcttttcctactttgggtgtaaggataatatgagccttgagttcagaagcttttcgtgttttgggggttctggtgcatttaggcagagtattaaataactttatcaatattgtctatggtcatcagttgattcagatttttctacctcttcttcagtaaatattggtatattttggtctatactttcatagaaagcaatctactgtccctagatttgataatgtattggtatcaagttatgtaagagtctcctgtgattttgttaaactgttctgtgtctgtagttatattttctttttcattccttatgttgtatatgttctcttcctctcttttaaaaataatatttccaggagttttcttgattttattggtcttgtcaagaattttcttttggtttgatttatcaatctcttttttctttctgttgcatcagtttctgcttctactttcattgatttattccttccttctaatttcctttggttcattttgttgttagatttttgcttcttgagttgaatgctgaaatcatttattttatttttttgtcttctttaaatgtgtattataaagatttaaatataatacatagattgtggctgtgtaaacattaaatgtggtcatgttgtacatactttatattctttttggttctttctgtttggctccccaccctctttccacatcagtccccttctcccccacctcagctaggtaaccccagtatgataatatatattcacatacacatacacacacacaaaggttttcttggacattatttgttttataaaattgggacattatacacacatttctcactcattaacacgtactagaactctaagtcaattggtatagctttaattcattatttttattggctatataagattctatggtatggctgtatcacaatttagtcaatatgttcactttattccagtttttggctactatatcctatatcattacatactggtgcttttacttctgttgaacaaacttgcaagaggaatattaatggaacgaagggaatgtttccttctaagttttaatttccaaagaggtcagaacttttcaaacatttctaccatcgaagtatgaaaatggccttctctctgcattcacatagcgataagttttatcctgtttttaaaatttgccaattttacaggtgtagagtgatattgcatcattactttcattgtgttatttttatttctaataagttgagcatctttttaaatgcttgttggctattggatttatttgggggatttaattagtcatatgatttgcccattattctttggactctttcatttaaaaaaattatgagaacccttttattattacaaatattaactctttgtcatgtatattgcagttttccccaagatctattgtttgtctgttgactttcttataacttttaccaaaacagtttttaatttttataatcagagatatcttttctttcatatcttcagagtcggcaaggttggttaaaaatgtttcccacacctcaagattgtacgtgtaatctcccagattttcttgcaagatgtttactgtttcgctttttatatgcattgcttcaattatctgctaattacttttgtcatatggcatgagagagggatttgtctagttttatttccatccagatcaatagcctattgtgatggcaccttttgccactgatttgaatcaacacattcatcatataaagttctcatatatattagcatatatttctggattcattaggctgtttcactaatctactattatcttgctatgccagtaccatagtgatttgattacagtgagcctatgatatcttctgatatctggtgggtgaaagcaatcctcactattctttttgtacctttcttagctattcttagacactttattcttccacataaaactgttaagatatttttcaaattaaaaagatccaagccctgttgtgattctaactgcaatttcattaaactcagaccttaattttattaatgtaataaatttaaatatttttcttattacatttatctctgtgtattttataagtgtgatgctattgttaataagatagttttctcctatttccatttatgagtgcttagtaccaaatagagataagctattggtttgtgtattttcagctttttcttttgagcctgggtctcattttgtcacccaggctggagtgcagtggggtgatctcaccttactgcagcctcaacctcctggattcaagcaattctcctgtatatcagccccccaagtagctgggactacaggagcaggccaccatgcccggaaaatttttgtatattttttagagatgggtttttgccatgttacccaggctggttttcaactcctgagctcaagcattccccccacctcagcctcccaaagagctaggattacaggtttgagccaccgcacccagccattgtatattcatcttaaatctagctaccttaccaaatttgcctattaattctagtaattttaccctaaagtctctgtgagtattgaatcatatcataagttaaatgagacagattttagctcatttccaatatttatagccagttatttcattttcttatcttattgaatttattagaaaacaagagcaaatgttaaataataacaatgaaagtgaacattccttctactctatgattttacttgaaataatttttgtattttgctatttagagtaacatttgctgttttggtttttgtaaatggtgtttattctattctcatttgccacaaaatgtttatcataaataagttttcagcagctggtatcatctgaattgtcttctttgatatgctgatgaacaaattatgttcatagatgtcctgacactaaatacccttacattcttggagtaaaatctactattcatggaatttgatcattagtgggttctatgtactatttctttagactattcttagtagattttcactactcaacctactaataataataaacaaagttttgttggctttatcaaatgaattgatgagtactccatctttttctattgcttagaatagcttaagtaacatttgaattatccattgtctaaaagttaggtgagactcacttatgaatccatttggtcctagtggcatttgcaatatctttaatcacccctccaggctcttctatgataatcagtcaattcaagtttcaacttccaataattatatacctttctaggaagtaactttatttattttttcaattttgttgccacagtgttgcatgtagcactcactcatgattcttttactccacattatctgtagttatgtgccctttcttattcctaaattcctctatctttgctatttatctttttttccttgaataagcttgccaatgacttgtctattttgttgctggtggtgctcttttcaaagaatgggcttttggattttttttttttctagttggtataaagcatttttattttcactgagcagaaaaagaagctattgattcattaactgtgctgctttattggcatgtagctatgcactgttcacacattaatatataaaactcgtcagtctgttttattttgtctgatgggaaaacatgaacagtgagatttcttatgcaaaaagtgaacagttcaactatgctagctccatatacctttattaacattccagagacttatcctctcaacatgatctgatttctgtaggataacttttcaggaaaagtattttctgatcagtgaagcttggagatataaataagcaatcggccaggtatggtggttcatgcctgtaatcccagcactttgggaggccgaggcaggcagatcacctgaggtcaggagtttgacaccagcctagccaacatggcaaaactccgtgtctaccaaaaaaaaaaaaaaaattagctgggcatggtggtgctcacctgtaatcccagctactgaggaggctgaggcaggagaattgcttgaacctaggaggcggaggtggcagtgagctaagattgtgctcagcctaggtgacagagtgagactccatttcaaaaaataaaaaaataaaaaaaagcagtatctctcatattcattaactggaccctgactttcttaaagctcaccccaaagctgaagtccatgaaggcactagttctcaaacttcagtgtgcataagaatcactcgggaagcttattaaaatttacattcctaggccccatcctcagcaaactatttagtccccaggtaattctatcccaccccaccccagctttattgtggtataattgacaaataaaagttgtatatatttaaggtgtacaagataatgttttgatgtaagtatacattgtaaaatggtatagcatgaagggttttcttttcatttttttcagaatagtttgtaatatcttctttgatttcatctttgataatctagacgtatgattttaattgctttttaaatttgtttatcaagttagtttgtagtatttgggtcaacattgaatatcctgttaatttcctattgctgtgtaacaaactacatcaaatgtatcagcttatgacagacccatttactgtctcacagtttctgtgagttagaagtccaggtggactcagctggatactctgtgcagggtcatacaaggccaacaccaaggttttaatagggctgcactccttagtgaaagctcttggggagaatctgcttacaggctcatttggaatgttagcaaattcagttccttctctcactttccatgtagtgccctctaccagcaatggtgcatcaacactctctcatgcttggaattgctctgacttcaattttccgtgcatatctctggccttttttgcctctctcttttacttttaaggactcatgtgattacattgggccgacctgggtaattcagaatactctccccatctcaaggtcagctaatcagccccttaattccatctgcaaagtttaatttgccacataatatatttttggacatgacaccaaggagcaaaggtgatgtgggccaaatttttacctgccacaggtatagtttacatacaatgaagctcatcaattttaaatatgcagtttgatgagttttgacaaatgcatacacttgcataaccaccaccctaatcaacatgcatttacatcaaccctcctgcaactttttaatgagtctctcccactgacctggcctcagccaataaactgctatctggaagttacagatttgttttcacatgttctagaattttacatcagtggaatcatacggtatgtattcttctatggctttttttcttcagcatcatgatttggaaattcatgcaggttgttgtataaagtatttctatcctttttattgctgattactgctccattatgggattatatcataattttggattatttccagttaggagcaaatacaaataaacctgctatgaacagtgctccacatgttttgtgtgaacatctattttcatttatcttagttaaatatctaggagtggaattgctggatcatatggtaagtgcatgtttaagagaaactgccagacagatttcttgaacgtaccattctatactcccaccagcaatgcatgagagttccagttgcaatatatcctggacaacatttgatgttgccagtacttaatgactgcacagtggtatctcactatacttttttttttttttgagatggaatctcatcccatcacacaggctggagtgcagtggcgcaatctcagctcaacatctgcctcctaggctcaagcaattctcatgcctcagcctcctgagtagctaggactatggtcacacgccaccgtgcccagctaatttttgtatttttggtagagacggggttttgccatgttggccaggctggtctcaaactcctggcctcaagtgatccacccgcctcggcctcccaaaatgttgggattacggcttgagccactgcacctggttatacttttaatttgcgtgtctctgatgactaaagatgttgagcatctttgcatgtgctaattagccattcctatatcttcttggaagtgtctattcaaatcattggtcctttgtttttaaacgtagtttcaacttttattttagactgaggaggtacatgtgcaggtttgttacatgagtatgttgcatggtgctgaagtttgggttacgaatgaatgatcctgtcactgaagtagtgaacatagtacccaataggtggtttttcactccttgctacccttcctcctccctctttcctctagtcgtctccagtgtctattattctatgtccatgtgttctcatcatttagctcccacttctaagtgagaacatatggtatttggttttcagttcctgtgttaattcacttaggataatggtttgccagtttttaattgggttgtttgtcttgttattgttgagttttgataattttttatatattctgggtacaagactattcagaggtacctgttttgaatgtttttttccaatctatggcttgcattttcattttccaaatggtgtctttcaaatagtggaaatttatagttgtagttaagtccaatttagcttttcttcttctatgattcatgcttttttttcccctgtcctaggaaatctttgcccacctcaagttcacaaagcctttcttctgttttcttctagaacttttatcattttagcattagtatttaggtttataatacattttgagttaaattttctgtatggtgtgacttttctttctctattgaattcccttggtgcctttgtagaaaattaaatgactgtatataggcaaatctgtttatggattctctagttccatagatgtgtatatctgtgcttatgccagtaccagattgttttgattgttgtaactttatagtaagtcttaatatcaggcagtctaaaacctccaacttacttttttattgaaattgcttttgatatatttaggcttttatatttctgtattaattttatagtcaactagccaactccaccaaatagccaactgggattttgactggaattgaattgaatctgtagatcaatttggggagaattgacatttaaacaatactgaatctttcaatacaacaacatggtatggctttgtttctttaaattttctttaatttccctctaggatattttgtagcctacagagtagttcttgcaagaattatattaattgtatccccaagtattttgagggattcgatgctattgttaattgtatcatttttatttgttttcgttttccaatcatttgttactaaaatatagaaattcaattgatttttgtatattgaccttgttcactctaatcttgttaatttgcattttagctctagtagcgttttgcacttcttttagaatttctacatatacaataatgttgtctgcaaataaagacagtttgcttcttcctttccaaactggatgctttttattttttttttcatgccttactgtactggcaagggcctccagtacaatgttagatagaactgatgatagcagaatccttgtcttcttcctgatttcagagggaaaatattcattattttaccattaagtacaattacttgtaaattttttcatagatgccctttgtcaaattgaggaagtttccttctattcttggtgtgagagtttttatcaagatttgatattagattttgtcaaatgctttttctgcatctattcaaatggtcatatggtttatcttgtttattctgttatggtgaattaccttgattgattttttaatgaggaactagctatgtattcccagggaaaaaatccacctggttgtgacatattacattggtaatattttcgctatggactgaattgtctccacctccccccaccccaaattcatatgttgaagtcctaactctcaagatgattatatttggagatagggcttttaggaggtaaacaaggttaaatgaggccataaggatggagtcctaatctgataggactggtggcctcataagaagagagaaggttctctctctacactcatgcactgaggaaaagccatgtgaacatacagcgagaaggcagccatctaccagctgggaagagggctccactagaaactgaccgtgctggcaccctgatattggatttccagcctccggaactgtgagaaaataagtttctgttgtttaagtcacccaatctctagtattttgttatggcagccctggccaactaaaactgttttgttaagggttttggtggtgatggtggttttttagtttttgcgtctgtgttcatgatggatatttggctgtgattttcttataatgtcattgtctggttttgatataagagtggtattagtccgttctaatgctgctatgaggacatacccgagactgggtaatttataaaggaaagagatttaatggactcacagttccacatggctggggaggcctcacaatcatggtggaaggcaaaggaggagcaaagacacatcttatatggcatggtggcagacaagagagcattgtacaggagaactgccctttataaaaccatcagccctcatgagacttattcactataatgtgaacagcatgggaaaaccccactgccatgattcaattacctcccacctggtccctctcacagcacatggggattgtgggagctacaattcaagatgagatttaggtggggacacagccaaaccatatcaaagagtaagactattctttttttttttttttttttttttgagacggagtctcgctctgtcacccaggctggagtgcagtggtgcgatctcggctcactgcaagctccgcctcccgggttcacgccattctcctgcctcagcctcccgagtagctgggacgacaggcgcccgccaccacgcctggctaattttttatactgatagtagagacggggtttcaccgtgttagccaggatagtctcgatctcctgacctcatgatccgcccacctcggcctcccaaagtgctgggattacaagcgtgagccaccgcgcccggctgactattcttataaaatgagttgagacgtgttcactcttctatttaatgaaagagtttgtgtagaattggtatcatttcttttttaaatgtttattcaccagggaaatcatcttatcccagtgttttttgttttggtttggttttttttttaagggtcttaattgtgaattctatttttaataggtaaagggctatttgaattttctatttcttataggataaattttaataatttcttttaagaaattccatttgagactgggcatggtggctcacacctgtaaccccaacactttgggaggaggcagcaggattgctctaggccaggagtttgagatcagcctgggcaacataacaagacttgacttctacagaattttttttcattagccaagtgtggtaacatatgcctgtagtcccagctacttggaaggctgaggcaggaggatcacttgagcccaagagttcaaggctgcaattaactatggatcatgctactgcactccagcctgagcaacaaagcaaggctctgtctcaaaaaaagaaaagaaattccatctgagctgttgaatttaatagtataaagttcagaatatttccttaccattttttcactccttggaggtatgatttacatactgtaaaaatcacttattttcagtgtggagattcttttcctttcctaaatctccacatttttattgacatatactttacatatcataaaattcaccatttgaaagtgtacaattcagtggtttttagtgaatccgtaaagtgtacaactatcatctttatttaattccagaatattttcatcacctcaaaaagaaaccctgtaatcattaaacagtcacttctaattttcttcctttccccagcccctggcaaccattaacctactttccgtcactgtggttttgcctattctggatatttcatgtaaatgaagggataaaatatgtggccttttgtgtctagcatcttttgcttagcatgttttcaagattcttccatttttgcagaatgatagaggagttaaaataagaaaataaagatatagtaagaatgaaactattttcattttttaatttaaaaaaatcttccatgttgtagtatgtatcagaatttaactcctttttatggctgaataatactccattgtatggatagaccacattttgtttatccattcatctgttgatggacttttggattgtttccccttttggctattatgaataatgctgctatagaacattcatgtacaagtctttgtgtacatatgcttttatttctcttcggaatatacttaggaatataattgctaggtcacatggtaattctatgtttaacttttagaggaactgccagactttttcaaagcagctgcaccattttacattttcactaccaaagtatgagtgttccaatttttccatattcttatcaacacttgttactgtctgtctttttaattatactcatcctagtgtggataaagtgatatctcattgtagtttggatttgcatttccctgatgacttacgttgttgagagtcttttcatgtgtttattgaccatttgtgtatctcctttggagaaatgtctatttaaatgctttgcgtgtttttaattggattatttgttttttagtactgagttgtataagttctttatttattcttaatattatacccttatcagagctatgacatgaaaatattttttcccattctgtgggtagtattttcactttcctaatagtatcctgtgatgcacaaagtttttcattttgatgaaatccaatatttatttattttacccctttggttgcttgtatttttgttgtcatatctaagaaatcaatgtcaaatcaaagatcactaagatttaaacctatattttcttttgagacttttatagttttagttcttacattgaggtcattgatccacttggagttaattttggtatatggtgtgaggaggggatccaagttcgttctacagcctatatagcctgcagatgagcaatgttagtgaccttgaaagtagaggcccaggttgtcagtagcctggcatctaactaaacaaccatttatccattaaagttagccctgttaacaattaatattgagataattttacttaatacactgtgtatattagtgtccatctagcatgcagcctgaggcacagagaataatagtttgagtataaaattgaattgaatggaatacatcattaatttattatctagctttctgttattgtataggcagtcacatgtatttaccagaaaaaagttgatagaatttttattttaatgaaacccttttatactttagattattttgatgctgattaacaggataagctgactctggacacatcctgacagcctctgccaaggtttgaaataaacagctgggaaaattcagttttatattatctgttcccgcagctgctcagtttcttctaaccacaggtcagggaatataataggttttccgattagttttagataaaatgtgaaagaacagttcatgtcaaggacaatggttgccaaatatatttggcaggatttctatattgaatcccaaaggaaatacacaaacaaaaccccacaaaagttaggaaggagtaaaacccaggaaccctggaacattttgtcatttactatgcagatttgcctgaaagtgagacaggcaaataaatcacatgtttctgccagcgtggaaaatattcactcaaatggcaaaggtctcaggctggggagctggatattgtcctgtaataggttcatctcagaactgaatcacacacttggagggtgttaatgctcttaggaacatctagttattccctttgaatagagtcctgtcctgaatcacatatacttgacctagggcctaggcctttttgtttttctgtctcacaatcttgtttctccatcaattatgtgttttcactcttccctcagagagggaaaaagtgtttctgtgtgctcttgatcctgttccctctctgatcttccaatctattgctctataacatattttatatgtgtcttatatcttcattttagtcagaaacatttatttatttatttatttatttattttttgagacagagtctaactctatcccccaggctggagtgcagtggcatgatctcggctcactgcaacctctgcctcccgtgttcaagcgattctcctgcctcagcctcctgagtagctggcattacaggcatgccccaccacgcccagctaatttttgtatttttagtagacagggtttcttcatgttggcccggctggtgtcgaactcctgacctcaggtgatcctcccgcctcggcctcccaaagtgctgggattacagatgtgagccattgggtctggcctttaatcagaaacatttaaagtgaaagcactgtggtaacttatgttgaaataccttagaaatcaatggaaactgcacagagagggggtaggatagacgtagtggaaccaaggatatgatatggaaaaaggagaaaggtagcaaactagggatgagttggtgaatgtggaagggcataataatgttaaatgactgaaaactacataggcttatgttaagactagtgccatggaaatttttagaggtagatgacattagagtatgtttaaatataaattaatgttcttgcagtgagccgagattgcgccactgcagtccgcagtccggcctgggcgacagagcgagactccgtctcaaaaaaaaaaaaaaaaaaattaatgttactggttgtgttccctagatgtagactctgagatgaagattaacatgcaggaattttatttggagtgttcttgggatcaacacctgaggaatcagggataggcagagggagaagcgcgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccaatggctgggactggggagttctttcctagactgccatccgggcgcccctcaccctcttgctgctcagctccaggtcgtcgtgggttcagggctcagctgcacgctcctgcccgcgccctgggcgtgatggcacccccagcccctgccattcttccccctcaccccctctccctgccactgctctgcattgccctgggttagcctggcggggccaggtggcacccgccgtatactcttgcctttctgctgcaggggcctttctgctgcgggtcccagagctgcagggaggggcggcagagactccccacgtggctcattggcgggggtgctaatcagagttcttttgctgccactctttgattcccaaaccccatgtaatcttcttagtggggacacagaatcatctttgaattcatacatatacagcaccttggaggctggccctccatcctcacagagacctgcctccaagctggagttctacctgtgcctggttgtggacccactccctcatctcttttgctgtacaatgattccccaggtctacacggtgctatatggaattccacatcagtgaatcaaatcctctgtaagatttcagatagtggtgctggctaaggccctgaagggaggaaaggctaagttacgccaagattaggtatcacaatgaagtcctgtcctttctaggatggaaggagttcagtgtgtctggccaccgagaagctggtttgtctctgtgatggacaataccatattgcagcaatccccaacctttttggcaccagggactggtttcgtggaagataatttttccagagactttggggttgttgggaatggttacggcatgaaactgtccgcctcagatcatgcggcattagttaggttctcataaggagcacaaaacctagatcccttgcatatgcagttcacagtagcattcgcactcctatgagaatctaatgcagcagctgatctcacaggaggcagagcccaggcggtaatgcaagtgatggggagccgctgtaaatacagatgaagctttgctccctgcctgctgctcacttcctgctatgtgaccccattcctaacaggccacagaccagtactggtcaggggcccaggggttgggcccaatatggcatattgggagctcagcattgatttttgttgctggcaggttggactttggtggcaacagtagctagatcagccttagtcagtgggaagccacgcttttgggtccatgcattaattctctccctgctgctgtagccacttagctcatgtcttgccagtactgcgatggcctatgcagaggctagctgatgtgaattgccagagtcatttttatatgtgttgttggtttgtgcttccttcaagatggatgctttctgttggcattaacgtattacttggagatttttctagtttgtgtccactcactaatatgcctttgtcccaacttttttctggaagagcttccttatcagtacgctgggccctggccctcagccagtacagaaagtcatttgtcaaggccttcagttggcagacgtgctccctggactacgtgctttctcgggtgtcccagaaaccctggaatggagtgaaatgcagggctacgtgggagagcagggaggcaagaattaagtcggccccacctttgcccaactcagtgggtctccttgagagaggtctgcagtttcaaggagacttttcagccaatctgctgcgagatcctgtgaaggggtgtgaaggtcttcctctgtgactatagattggccagtctctccttgtgtgtccaacagttttcattatactttatgtgaattaatgcaaaactgctaggtttaaactgctcaccattttagggatcccttctggattttaccttccttaaggggaaattttcctcctttcctcagttcatcctttctgccttggctttgacgtggtctggaggccacagagcctcctcctgagaacctctctctggtgtgtctgtttgtgtccgtccctctcctttcgatcattccctgtggttcctgttgggcgcggctcccataaacgcacagagcagggtctgctttgtctgcaacctgatgcattgttatttctcaccaaaacttgcagtccaaacatcacatttccgggccacactctttgtcagagctccaggggcacaaccccggggacctgctggaaggtgccaccgtgacgtgtgcctagatgcgttttccctcagttaccacagcgttcctctggttctggtggctggagggtgaccgcgtgcttcatgaagggggtccttactgcttcgcatccacccttttcacggaaagcactttgtcacatgttttcagtgtttctaagcgattttctgccaatcttgtgtgctaagattgtgtggcagcgtttccacagatttatagctggcaatgaattctcccaaaggaaatcagacaaaataaaatgtttccaacattgttcacatactgacaacttatgtgcttccttgggtgattttacaactttttaagcacatgaataaaaattattgtctgcttttttctccttttttctctcttttttttcttgcatgcagaaagtttataggagggggatcctctggatcaacacccatgggggagtgaaggaagcaggattgggtaaaagaagttgaggtgatacagtctgaataaaggtcagtcccacagggagctcaagctaggatggctctgcagagatgttctctattgaggcaagttgtctggacctatatagtcccacctttaccaggaataaggcatgagtttggatgtggtgactgacttcagccaaaattggttctcagagaggaattcagattagagttgtcagctgtcagcacacccagcagcttaggaaataagtgctttagtcctgaagcggtgaatctggacaccagcctccactgtggtccaccctttctgctgctcagattcatttgcttcataagttctggaatggttccttcaggattctgatgggctccctttcctggggaaacaaaagagaaaggtttggaacacagcacaactcctgctgctttagcttttcttgagtctgcaactggtactcatcatcttccccttctactacccattctagatccctccccccaccaccctctcaattcatacttctgctgctccaagtgggttaccagataaggtatctggtcatcatgccctttgtaagccatgactgtacttgtccatttatcatcaacattgaacaagggaatactaagagatacccaggcagatgacctggctgccaaatatattctcctctgtctccattgtgtaatgtcagcccttcctcctgatgatcaggatcggttacgcttgccaggatagtgactcttttccttacctcttggtctcttaatagtgatctgaagtaatatgatggcaaccatagtttcaagtttaatgagactcttggtgtgtccactggcggacatattccccttttaagaaccagtacttctaaactctcagagcccagagttgggataagaggcatagtttccctaattgggtcactgggagtaatggtagtgtgaggctgctcctacttacactccttgttttccaaaaccatatattttacttcgggacacaccccactaaacgatggccattgatctagagtatatactgcatcctgcaggatggtgcctcgtccttaggtattatgtctaagctagtgcctcagctgtgccttcaacaagctgtcctaccactctatcaagtgggtagcttctgggtagtggattccatggtcatgtatcttcttgctttaaagtaggtctcttggtctgatgcagtgttatgtaagatcaaatattctgtgaggccttgaatggtggtgtttactgaggctcaccaagcaactgaatgattttcttgagaaatggtgacatatcagagccttagctttggtctctgttactggcaagttgaacattaacaacatcagtagctagatctgtattgatgagtccatgatgttgggcccatgcatagcctctgccatggctcctcctttcatacatccattttgtaagaattggggcaccaacagcagagactggtaagcatcaaagtggctaagtcattcagtctacttggttgtttagtgctgtttctgtggctgatgttcttttcatttattcattctgtaatgcgtatcctttgtagattcaatttccttctctctgaacaacttctttggatatttattgaaaggcaggtctactgtcaataaattccttaatttttattgtctgagaaagtttttatttctccttcatttttgaaggatactttcacagagttcagaattttaggttgactgttttttctttctctcaacactttaaatatgtcagtgcactctcttcttgtttgcatggtttctgaggcgaagttggatgtaatttttatctttgctcctctatggataaagtgtttttccccatctggtttcttacaacattttttgtctttgattttctggagtttgaatataatatgcctaggtgtagggtttttttatttgtttgctcgtttgcatctatctttttttttttttttttttttttgagacagaatctcgccctgtcacccaggctggagtgcagtggcgcgaactcggctcactgcaagctccacctcttgggttcacgccattctcctgcctcagcctcctgaatagctgggactacaggcacccgccaccacagctggctaattttttttgtattttttagtaaagatggggtttcaccatgttagccaggatggtctcgatctcctgacctcgtgatctgcccgcctcggcctcccaaagtgctgggattacaggcgtgagccaccgcgcccagctgcatccatcttctttggtattctctgagcttcctgaatctgtggtatggtgtctggtgtctgacattaatttgggggaaattctcagtcattattgctttaaaaatttgctcctattcatttctgcattcttcttctggcatttccattatgtgtatgttacaacttttgtagttgttgttccacagtttttggacattctgggcccatgcatagcctctgccgttgttgttggtgtttttttttttttcagtctttttttctctttgcttttcagttttgattggaagtttctattgtcatgtcctcaagctcagagattctttcctcagccatgtctcatcaaccaatgagcccatcaaagacattcttcatctctgttacagtgttttgatctctagcatttcttttttattctgtcttagaatttccatatttttccttatgatatacatctgtcattgcatgttgtctactttttacattaaagccattagcatattaatcatagtttaaaaaattcctggtctgataattatgacattcctgccatatttgactctgattctgatgcttgcttgttcagtctcttcaaattttgtgggttttgccctttagtgtgccttgtaatttcttgttaaaaggtggacatgatgtactggctatgaggaactacagtaaataggcccatagtgatgtggtgagatggaaagaaagaaaagatgctcaacatcactaatcattagagaaatataaatcaaaactacaaagagatactgcctcacacccattaggatggctactatcaaaactaaaacagaaaataatgaatgttggtgaggatgtggagaaattggaacccttgtgcactattgcaaatgtacaatagggcagtttctctaaaaattaaacagaattaccatatgatccagcaactcgacttctggctatatatgcaaaagaactgaaatggggtcttaaagagatatttatacatcaattgtattagggttctccaatgaaacagatccgtgtgtgtgtgtgtgtgtgtgtgtgtgtgtgtgtaaatatatgccaatggtaaaagtacagggtctgagtcagaaggcagaaccaagaatgcttatgtccaagggcaggagaagacagatgtcccagttcaaacagggagagtgaatttgcccttcctctgtctttttgttctattcaggccctcagtggaatggataatgcccacccacattggtgagagtgatcttctttaccaattcacatgctattctcttctggaaacatcatcacagacatacctagaaatactgttttgccatgtatctgggcatctcttagcccagtcaagttgacatataaaattaaccatcatatccatgtttataagcagcattattcacaatagctaaaatgtggaagtactgcaagtgtctattgacagatgaatggataatctaaatgtggtatatacacacaaagcattacgaaagaaggaaattctgacacatgctacgacatagatgaaccttgagtatattacgctaagtgaaataagccagtcatgaaaagacaaatgctgtatgattccacttatattgggtacttagagtagtcaaaatgatacagaaagtagaatggtggatgccagagactggaggaggtgagagttattgtttaatgtttatacagtttcagtttacaacataaaattaattctggaggtagatgggagcatattacacgttttctttttggagatgggatctcactctgttgcccaggctggagtgcagttttgtgatcatagctcactgcagccttaactgtctgggctcaagtgatcctcccaccccaggcaccaaagcagctaagaccacaggtgcacaccaccacgcctggctaattattattatttgtagaggccaggtactgctgtgttgcccaggctggtgttgaacccctgggctcaagtgatcatcctgccctggcctcccaaagtactgggattacaggtgtgtgccaccacacctggccagaatatttaatgctactgaactgtatatttaaacatgcttgggctgggcatggtgcctcatgcctataatcccagcactttgggaagccaaggagggtggattgcttgagcccaggagtgtgacaccagcctgggcaacatggtgaaaccctgtctctacaaaaacattaaccgggcatggtggcacacgcctgtagtcccacctactctggcggctgaggcgggaggatcactcgaacccgggaggtggatctcgccactgcactccagcctgagcaacagagtgagaccctgtcaaaaaaaaaaaaaaaaaaaaaagatttacgatagtaaattttatgtgtattttaccacaattattaaaattgaagaaaatccccatgggtcactggtttaccaatttagccattttcaccatttttagattgcattttccttctctatctcagcattctgactaaaggaaaagcaaaatttcttacaagaatgaatgattctccagtgtggctgctcctgaaaggaacaatgagacttttgttatttcaccacaagactgagaaagaaataaacaagtgataaatgcccagaccccttcttattcattccacatcctggtaatctgaggcatggtgtggcttttactccaagcatatgaatacttacaatcagaagctgcctctcctttccctcactttatcattattgccatcatttatgacaatggagggagtgtctcactggatgatatttggggttctttcttcagtggtccgccataccaagcatttatttgtgctgttctccatctttcacatctaccacttttcaaaagtccctgagagtcaataagacatgcgactcgaacaactgcttcacatctaagtgtatgtctttaaaaatctctccttttccatgtttatgtctgatgtgttttgttatggcaaagtggcatgtagtatacggttcataagtgaatcgatgtatatctgtggagggcaaatgctcaattttagatctacacatgaaagcttttttccagggcaggagccttgctttctccaactaagccttaattacccaaatgcccatgtgttgtgcctttggcttgttgaaatgataccaactggtaaaatctgatgggagataaaagttagatgtccagaagcataaaagtcaggaagagaggctctttatggcatagagaaagctgcagaactgctccatggtgtgcaaaactcatcagcacatgaaactagtgagtggagatagtcaccttcaaccactttgtaatttctaccaattcacttggggccagtgtcccttattcaccaagattcacattggtccttttgattatttggcgtgaggaggcccccagacatgctaaactgtcatgcagggagagaggaaaagttgggaaccagcctttgcttaaaagggctttgacaatggaggcaaataataacattttgggaacatttatataagtaattatataatttctgattcagtagctggttcatgaataaatgagtaattgggagtatctgagtggagacaagaatgaacattaatgtaggactgattctgaattacagcttctggcactagtaggtttcaatatacatagtctgctgaaaggtaattttctctgtgatattcctggtatccctaaggagggaagtataattttaggtacatactgacaaaatttgaacacaaggtacttagatgaaagttatagtctgttttagagatgaaattgaaggatgcagtagctattgctttggcaaaggatttttggctgatgcagtgtatggttattgattttatgattcttatcatatggcacctaatgtatcagttgagttgtgaaaacagtgtttcggtttaatggatgttagggatttatatacaacttcaaatttgcctccttgctaatagtagaaaagagtagtatggaagcattacttccagctgctttttgaagtgtccaccaaaatgaacgactttttcctttcttcacgcagatttcctcctagagtgccaaaatcttttccattcaacacctcagtcgtgtacaaaaagactctgtttgtagaattcacggatcaccttttcaacatcgctaagccaaggccaccctggatgggtaatgaaaacaatgttgaatgctatttatgaaattgggtatcttattttctatcacagattccccaatcttgaggttgcagttaaaaagtgcagctgccaaagagaatgtttccctaactgctacctatagggaaatacactgactgcattttctgtctttttgctgggccgtcttcctctgcttggtctatgccaactgcttacctccacttagatgtcaaataaagtatgtaacaacatgttatgacaggacattttctgtcttagaattgttgctgagaattataggtgggaagtatccccttattctaaagagagatatcagcctatcgatttagaacttgttcaggtagtagtccaaaattggttctgcaacccttaggccctgactcacctccaaccttgtataaaaaaaggctaggaacttatggaagactttagatttgaatatttattatttggagagcctcttcggtgttttatgtgttgcttaccccatggggagtgggaggcctgtccctcatgtcaaggtataatgaaggaggcttcaggagaaccacttagaagactggacaaggtacctatggaacttgggagacactgaccactgcctggtttttatctggataaattttcaaggtcagaggccaaaaggacttctcctgatggaatagcagggggagtgggcaatagtgggagctaactgcactaccattgttaggtgtaaggccaggaaggtcactgaatgggacttgtcttacaaagactctgcctgagaggtcttcctgccaggattagataaccccaatagaaaaagcctgtatgggttgtactgccagaagcagaatctgagaggagagatacaagtgaccagctggagaaggtatatcccatgccaagatcaggagcagtggggtgtctccttgttggcagggagaggtctccaaataactcataagttccctaagaaagaaaggcagaattttggtatgtgtcacaactagggagtactaatgccacattatcactgctccttccaagaaagactttgtcattgtgcctatttgtttttaccctcccccctcctttccacttgctcctaccttggcaggtccagagacacaaaggtgagttggggaggaagattaggagaggaaggtgggaaagcagcgaagctgccaaaacaaattacctttacatattgcagatttctggggctgtcagaatgtagctggagaaggaagggaacttgcaattgcagaagacatcaaaaatttggtattagactggactggacttgttagaacctaagagtgatactgttggttaatacctgaaggttactggaaaagatttgggatcaaccaaagtgcaagaaaagggagatctcacataaagtaattaaaagcagtggtctaagaaaaataaggctattttatgtttttatcccactcaatccagttcattcaacagactgtttataggcattttatacttagtgtattcataaaacagagctcttaattttcctcctgattttctgtcatggcctgactaacaacccagttgcacaagccaaaatcataggagttttctttgactcctctctttttttctatctccacatcatatttatgagcaagtcctgttgactgttcctccaaaacaagttccaagtcttcttattttacttcttgtaaaatccaaattcatccaaattcctgtggcctgcaaggtcctacatgttatgtttcctttttgaccatattttctgttactcctctgctgattcactgtgcttcagccacactttacttgactataccaaacttatttctgcctctggacgtttgcatttgttttatctgttttcaatgctcttccactagatctttgaaaatcttgcttctttttcattagtcagatctctactcaaatgtcacctcctcagagaggcccttcctgactactacactgaaagtatcctctacctcctgcctcatcactttctagcagaccactatcttttatatttataacaacttgaaattttcttatttatttctttatgtgcttaatgtcttgagaatatgatctccattatctgtcttgtttgctactgcacctccagtgcataagacagttcctagaatatagtaggaactctagttgaatgaatgaatgaattgaatgattgccagaaatcttgcctcagagcaaccataaggttaggctgatgttggcagcaagcaaatactactttttgtcagtaattacaggggcatgcttctccactgtgaccttgactctaacttttggaataacaggttttctggagtactatccccaagtaacctttggcggacatctcattcttacaggtctgctaggtcctaccatccaggctgaggtttatgatacagtggtcattacacttaagaacatggcttcccatcctgtcagtcttcatgctgttggtgtatcctactggaaagcttctgagggtgagtaaaataccctcctattgtcctgtcattctatgaatagaacagtgagatgtgtgtgctttgtaatggtggcgttacaactcttttaaggtcctaactgaacattatgtgtatttcttaacatttactagattataaatatctcaagatagggaaatccatcttatttattgctgtgtccttagcatataacatattgcctaccctatagtagatactcaatacaagaatgagggtgtagtggacaccagtcattttttcttcctaaaattaaacatttctcacctgtataccccctaggaattgcttttctgaatatacttcaaacagaacctgccattttcttaaagcccatgcctccctagccatagcagttgatctaggagtgagcagttgacacgggtatcccacctccttggccacagttgattggtccagagatgggcaccttacccaagctaggccaatgagagtacttgcactagcattttgaaatttatgagaaaaaggacctattattaccaggtaatcctatacttaggggatggagcccaaatataataaaatcaagattctactacttcatgtatatcatgtgggccatggatcttataggagtcttaagggggtgttggtcttgtccttttcttagttgcctagctctttgcaggcatggtgcaaaggcaggacaatctacctttatctgctccttctataccactgatcctaccctaaacatgtagctgtataatcagagacaggaagccatggcaaatctggagggtctcggcttggctatatcttaaagagttacatgtattcgtagttcaacattggggaaattttccaaaaattggtggagaaacgagtggccaatgcaattttatctttttttttctgctgacatcagggagagataagagctttaaaatcacaattatggggagataatattttaaaatccagctcaagttaaacccatcagaaaaggtaacaccttttgggacccccaaatggccacatcttatccaatgaggggacaccaaccatagagtctatactgcacagttcaaatggtagccatgagctatcaggcacttgaaatgtggtgagtcctacttgagacatactgtaaaatatacaccagatttcaaaggttaagtacaaaaaagactaaaaatatctcattcattgtttataagtacaagttgaaatgcttatatttggatatactaggttaaacgaaatacattattaaaataatttcacctgtttctttttacttttcttaatgtgactaccagaaaatttaaaattacatatgtggtttgcattatatttctattgaacagtgaaatgtttagcatatgttgaagttgctgctcctgatgcagtggctcatctcagatttggccaagttcttctgtccaaggaaaactaggttcaacccattcctggagaggaacagactcaaatctttctgggctgggtcacttaccttggttaaatctgttctccacctattctaccaacaaccaaagggatggacatagctgaaataaaaatcacgcaatcacactgaatggtatctcacctcaggtgggccttcagcattgcctagccattctactgctacatttcccctaatccatttactctccctctccccaagacagctataatgtttcacacattgttagcctctcattgaacctccaacatgtgctcccgcccctgcccccaccacaacgtgagccttgggaaaaagggtatttttttcctaatgaaatatttcaaacaaagataaatacagaaaataatataacaaacaaacatgtgcccatcacctcactttgccaaatcttaacattttgtcatctttgcttaatttattttacaaaattaagcattttacatacagtctgtactcctctatggggctggcaggaaaaggctctcattgtcaaagttcaaagtaattgatcattgaaaaaataatgatcacattaaaaacaacacttatataatagagatacatattgtaatactcataaatgaaatgatatcctgtctaggattggcttcaaacacatccaagctgatgttacaatcattaggtgaattcctgatgtggaatttgacatttgtatggcgccaaaataatatcccagtgatttttttctgattgtaagtggaaatgttaactttagaatggaggtatcaggctaatccacaggtcagttttagtgtcactaaggatgggatggccagatattatctgcccctgatatggcacaatatgagggactcagcatcatctttgatatattttagccaaaaaacttatttaatttgaatctaatcagaacttaggcatattcaatagcatgggatattctacaggactacaagccaaatttctttcaccaaatgagtgtcagaaaaaaagggactactccatactaaaagagactatgggcctaaacaaccagatgcaatctgcagtcttaggttggattctgatttggaccaactagctacaaaggatgcctttgaggcaattaagaaaatttgaatattgcattgatattaggtgatattaactggatcaggtgtgctagtgtcattttgtttatgtgggcaatttttttttaaagatgacttctaaagtatataggagtggactatcatgaaatttgtaatgtacattaaaatgcatcatcataaaaagtgtgttgaaagaaaaaagtgaaagtagcagtgcaattctaagaataattttctaacatccactcacaaaaatattaaattctttatattaaacacatgaaaaagaacacaaatatatctgtctttcaagattcatctcaaattccacctccttcatcaagcattactgaagagtaggaagcttgtttactttttttatccactgtgttgctcgctccaagggcatagagacttctatcttgatctttatattttcagcttgtagctgagtctggtaaagaataagaactcaataaatatttgtgaataaataggtgaatatttccacatggtattataattatatctttatatgtctatgtcccccaccaaacatagtgttgtaccactaggaaagaacaaagtttaagaaattttcttaaatctctctttcttactgttccgtgaccctcactagtgcctaccaaagagtctgtgacaaagtgtatttgttgttgaattgaattaggcaaaaagatgcaataatggaagcaatttattatttaacagaatgtggagatatcaaccagaacctagtttttactgctcatgctagggttagtgatctcaagatcctctggagtatatgaagcttctccccatttgtggctgctgcttgttagtttttcaaattaagatgcagaaagtaggccgggtgtggtggttcgcgcctgtaatcccagcactttgggaggctgaggcgggtggatcacaaggtcaggagtttaagaccatcctgaccaacatgatgaaaccccatctctactaaaaatacaaaattagccgggcatggtggcacgtgcctgtaatcccagctgctggggagtctgaggcaggaaaatcacttgaacctgggaggcggacgttgctgtgagccgagatccagcctgggcaacagagtgagactccgtctcaaaacaacaacaacaacaacaacaaagatgcagaaagtccgtttcttatgtagaacctattggtgacaataaacttgacatgtttctttgagtgtacagtggatatagaaaggacaattttatttcttcctgctataggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaaggtaagtgtatgaaagcgtaggattgagatgaaataagcagagaagtacaaacaactgaatctatctataacagttagcatttgtgttccttcacctgaaagaggcttttttactctagcatcatgctcatggaaaggagaataatccagtttctgagagaagcagatatgcattctatataaccacaataaactctaagctgggatcaggaggagctgagttccagaattaaatctctctcctcaaagcattgctattttcctcttcaaatctgtgggctttatcagtagtgatttctactgtcctctgccttttgcaaactttgagctaggttccttgaaaacttcatggaggtaaacacatccaagtgtgtgatcaatggcatatagactggttcaggtggttagtttgtcatctgtaaaccaaaagtatataaaaatctaagaaaagtcagcatttatttatatgttactgaaaattaattaatttggattgaattaatatattctaaaataattctaatcaaacctgtttttaatttataccttagcataaattagggaagtaaattttgcataatttgtttttatcctattttttatggtgaaatcagcttcactgtaccttttccttgttccatttatcttttactgcataactccacaatttagtggcttaaaacaacaacagtctcttattatctctcatggtttctgtgagtctcatggaatttgtcagtgttttgacttggtggcctatctaagtgtgtctcatgaggctgtagtcaaacagtggctagagctgaaatcatcccaaaggtgactttattcacatgtctttgaccttggcttgatggtactctccacatgatctctctcacatgggttttacagggtagccagacttcttatatggtcctgagatagcccattagaagctgtttcacgatttctaatgtaaccttggaaatcactcacataacctacattctattagttagaatgcatcactaagaccagtctataaagggagactccaccttttgatggggaataggcaaagaatttattaacaggaatcaccatactctttctgaatggtgatgatgaatgtgattcaaaaaaaggatgggagcggggagtggagaagatgagaaaggtttgtagtttataatagtttcagatgaaagtatgatttctcatatactgagttcagtttcatagtcataattaatgagaaagtgccaaaaccacagtgtattatttatgggatgtaaaggctaatggaacaatgagatcatcaaaacattagtgtttacatatgacatataaagaaataagttaaaaacccaaatgattctttgacacagagttgaactaaagagtctacagaggttctagttccaggtgaaatggataaacacactccaccctttatttcccattgaacttaactataaaaccttgacaaaatgcaaagcccagatatttaaaaatttctaaaaagcaaatagaacaagtatatagagaaaagacactagaattgaaagtattaccaaacttgtgggggagtatacctttttccccactctagtattccttaacctgaattaaaacataactggagacttcgaagtgagtactatgttgcaaagagagctccaggacaaaccctctggggtttcaaggagtgagaaaggtaactctaaatgctcagagagcgtgggaggggaaatcccctagggtttttgtcctcttttccaccattctctcaagcttcagtcccaggttgcctgtggcaatgacagtggctggcaacagaaacctgccggagtaaaaacttagggaggggaacattattcttcattcagtacagctacagatctaagacattgggggaaaagcacattactttctctctgtctttccccttccattgcttgaccttagctatgatgtagttgtggaaattggaagcttctggttagaaaaccaaaaaagggagctcacagaactggaaagtttatagatgacagagagaaaagatcccaggaaagtaaacccataaagttgtgcattaactcctggattcacccccaacctacacatccaggtatgtagtttcagtgtcagatctgttttaaaccccttgcagtgccattgagtccaacgcagtggccagtctggtgcttgaggggaaatctcagtttcacagtcttcaacatgttccattagcctttacgtcccataaataacacactgtggttttggcactttctcattaattatgactatgaaactgaactcagtatatgagaaatcatactttcatctgaaactaacgcccacagaattccttaaaacatgtctgatggctgaaagcaaagatagaacattgtgagataggttttttaatgtatggtagatacaatacataaaagaatcatagcataacaagaggagggtaaggaaaactttatggtccattcaacttcattccaattcaaatggtaaaatgttgactctaagtagatgatagtgaaaggttaagtatgtattttgtaatccctagagcaaccaataaaaaattataccaagagacacagtaaaaagtcacaataaactaattacaatggtatatcaaaaatattcaaataactcaaaagaaggcaagtaaggagagatgaaaatcagagagaagaagcagtaaaatcataataaaatgataggcttaaatctaaacatatcaatacttacattaagtgcaaatggctaaaacacaccaattaaaaacagagattagcatactggatataaaagcttgaaccaattatatgttgtttacaagaaactcatttcaaaaaaatgatataggtaggttaccagcataaagatggaaaaggatatatgatgcaaacatgaatatgaagaaagttgaagtagtacaaatctgtaatcacaacattgatttttgccaggagtgccaaaaccattcaataggggaaagaatagtgtcttcaataaacagtgctgaaacaggtgaatatctgcatgcaaaatactgattgagtatcccttacctgaaatgcttggaaccaagaacgtttcagatttcagatactggaatatttgcacatatataatgagatagcttggggatggaacttaagtctgaatatgaaattcattttggatataaatcccttgccagttatgtgattggcaaatattttctcccactctatagtttgttttttcattcttttaatggtgtcttttataaagcaagagttatatggacaaacatatgaaaagatgttcaacatcattaaccattagggaaatgcaaattcaatcaacagtgatgtatctattagaatagctaaaataataatataaaattgccaagaatcctgtcaagaattcagagcaacagaaagtttcacaatgcacaatggtatagccattctggaaaacagaatggcagttttgctgcttggtagagaaacagtctctggcagtttcttgtgaaattagatgtacactatagagggatagcaggagggagttctttttggatattgaaatggatctgtatcttgacgatgatggggtttcatgagcttatatctttgttaaaagttatagacctatacaccaaaagaaaaagtcaatttcactataattgaaaatttatataaaagtaattagaatgttttaagacagctttatacgtattttaaatgtgtctctaaagtttttaatccagtacttctggtaaagatggcacagggtcttcctacttagccatttttccatcctccacctcaaccccaacctcgctgaaaaccaacaacaaagataggtaaaccataaatagagaaaatcgaataggcatggtcagctgaaaaagaagataaatatttgtggaccagaagcagaacaggaactgtgagtagtaaaaggggtggaaattacaggccaactgagatctgggtcaggaagccagctgcggtagccaaggagtcaggatgacaaggataaatagtgctccccaccagagggactgagagcccatatcatagagttgggctcttcttcacttgaaagagagctgagcacagctgctgctcactctttgtttagggccatggctttgtggaaactcagagtcctagaagaggggaaagcaaacccagtcctagaataggaactgaactaagttttcttggttcagtgggggaatctgcaatatccccaaggtttccattggccagtatctccaaaattccattctagggtatgatttgctagatagagaatagtgaacacatcctttgcttaatcaaccaatgatcacaagggacagcaaagatcactatagttcaacaaagtcagatttattggctcatggcaacaagagactgtggacacctccctaaacaaagggaaatactgtatagagttagtaaagaattttggggaagggtggaggttaggtgatatttaaatgaagcaaagtagagttgtgtgtaaagaaataaccatgaggtctagactgtgaagtgttctaaaaagttaacatagacatgaaaggttaagtcaaggcaccccttacctgaagcttgagctttaaattgagctgcttctttgtgtcaaagtaatttagatgacctaggaaagaatgagatgtttcattcttgttgctattagttcaaacatttctggcaggctgtgaattcagagaacaaacaactcaattgagtaagaaagcaagagataatcaaagcaaatagttggcattcagtgagtttatacagtggcaatgtgtccttgggagaaatggtgttgttaactctgcagttagctttatctatgtctcttatcccagcctgatgagtagcagcacacgtactgttgctttcttagtccaagctaatttttatttctaagcattaagggtgcgagagagagaaagaacggcaaaatgtcataaacaaaaatctttctactcaaaataagcctgtaaacaaaagtttccagtcaaatttaaaaaatatataattctaagaaagatagccaacaagctcaacagttaaagcatgaaacaagctagtttgttccattaaaaacttcagctatcgatatacacggtatttatttaaaatgtgagtataattagaagcactgtgggctattgaaaaaaaatcatgagtatagatgtttaatatggacaattgctattttactcaaaacttttaatttacaattgcagaagtataaaaagttacaagagtaacagaaattatctataatttcactattatcacacagtgtgtgagggcttgtattttgtaagtgtttttaatttttttctttagtaattcatttttatcatattttacacaagtagtggtcttcatcaaagttgaaataaaaaaattctttgctccagatagttttagaaacactgctataggagacctgacatcaaagccaagttatcaagagacagaagactacatttgttcttactgtcaagtaactgatgaagaactgtctcctcctagtgacaatttcctacaatgagattttttaaatagaagataaatgttctcacttctttttcagggagtctggccaaggaaaagacacagaccttgcacaaatttatactactttttgctgtatttgatgaaggttagtgagtcttaatctgaattttggattcctgaaagaaatcctctgctactattaagaggaggtgattatagaaagatcataaattacattactgttcaggaatgaaggagatggggttaaaaatgaattccaagaaaacaaaacgtaacctcagttccactggcagctatgaggtaagaagatagaggagctggataacggactggcctcatccccctcattaagactgtcaacaaatactttgggctctactttctaaatactttctcttatcttcatctattattaagtgcacaacctttggcaagttatttaacctctctgtgtctcggtttcctaaatggaaataatagtacatttttcataagattgttgtgagtgctgagtgatttcacttaagtaacctagagcactgtgtggcatagagtaggccctcaatagtgttagtacctccgcctcttcctcctcctcctaatgtaatcactatgtaatcatagtaacataatattcttcttgcccccttatcaatttacattgccatcttcttaattgaggccctcatgatctgtctcataactctcaaaggaagcttactgaagtgagtatctgatcttgtcactctagcctctacaatacttcagtttgccagtttcggtggctcatgcctgtaatcccagcactttaggaggctgaggtgggcagattgcttgagcccaggagtttgagaccagcctgggcaacagggcgaaaccacatctctacaaaagaattaaaaaatcagccggtcatggtggcgggtacctgtactccagctacttgggaggctgaggtgggaggatcacttgagcccaggaggtgaaggttgcagtgagctgtgattgcgccactgcactccagcctgggtgataaagccagaccctatctcaaacaacaaaacaaataaaataattcaatttcaaggtaaagtgcaaaatgcattatctattctctggtgacatttccagccttgttgtgttccatttcctgccttatcttccatgtcacccaaatatgtaatgctttttcttgcatgagacctctgcatatgcagtttcctctgcctggaaaaatctgtctccctctttacactaagtaagcttctcctttttctttaagtctgacttacttcagttatccccttccttaattccttctcccaggatgacctctagtctggattagatgcctgcttatatttccacagcatcttgagcttattccttatcatactatatcagtattttctactttatttaatatttatcttctttgatctcatatctttttcccttcaagcaaagtgaaatttcttctcctctctgctccctgtaacaccctactctcatctttattatatcactctttactctttattataattatcagcttctctgacgattccagctagagtgtaagcatcttgaaagcagaggctgtatcttcctctctatcatcagtgtctacaattagtagtgctcaataaatatgtgtttgaatgaatgaacaaatgaatggctgcctcataaagttttagcactagctaccagtccttcacacaaaggggtaactccagggagtcactgttcaatagtatttccagtgcttcagcccttatcaatttcagagacagtgttagggagctttcaggttcctggggtttcataaatataagctgggatgaagcaattataacggagacagggactgacagacagcctttttcctaggacaattttcttttttcttttcttttttttttgagatcgagtctcactctgttgcccaggttggagtgcagtggcacaatcttggctcactgcaacgtccacctcccaggttcaagtgattctcctgcctcagcctcctgagtagctgagattacaggcacatgccaccatgcccgcctaatttgtgtatttttagtggggatagggtttcaccatgttggccaggctactctcaaacgcctgacctgaagtgatccacctgcctcagcctcccagagtgctacgattacaggtgtgagccaccgcgcccggcccctaggatgattttcataagctttcttttaaataattcagctaataaaaagaattgaatcctgatgcctcaagctaaccaatattctgtcttctattattatccattcccacttattgtcatggacaaatggagggagagaaaatcagtttgagcaagagatgtctgcctttacataattatcttctccctccctcacactgactttgagaggataagtgctgtgtgcctactttgctgacaaaaatgcttaaggtgtgagcacactgggagcagggaaggagaaaggggaggcggtcattcatgagacacatgcttagctgactctatctttgccttctctctcatcagggaaaagttggcactcagaaacaaagaactccttgatgcaggatagggatgctgcatctgctcgggcctggcctaaaatgcacacagtcaatggttatgtaaacaggtctctgccaggtatgtacacacctgctcaacaatcctcagggtcttccaaattcagcaccagagttctgtacttcagttcacaaacagctcggcatctcagaggatatagcccactgaatacttgaagatctctggcctctggggatcttaatgtatagtaggcaattcctcttttggtcacctgaaaatgaaggcttacccatgtacatacagcccacagtcagatttttctttccttttcttaaatgtgagtgggcaaccaaggatgaacagacatttaaaaagaacctaaaatatggaagggatatgcaaagatgaacaaagaaaataataatcccagaataaaaaaagctatggctcagaacagaactcatcggaagctcttacttctattttcataaagattcaagaagatactgcatcaataaagtaacaataagatgccttccagttttaaaataggggcatagaggcaggctggctttactccctctcacagaaaaccaaaaccaaacatacagcaccaatatctacaccaacaacaacccagagctcacatgtgaggatgagacagttcccggagccacagagaagtgaaaaaactttgagaatcagacttccacatccatgactctccttcctcctattctgcccagcaccaagtgtatggaaaatctcccctcaactcatggtttctacactggaaaaagtgacattgaggtgttcaaccagcttctccaccttcttgggttccctggggggagatttgtccttgccttaacccacagaaaacatcatgactgtctgaaggcagaaatatcccagagtacaggcagagacaaatgagggaggaaggactaccatccccagccctggaaattctgctctataatttggccaaagacatgcaaattcagaatggccgtgcagcagcaccatgctgtagcaggtttatcctacaggtcaccttggcatgaatcactagctggccttccaacactgctatgataatccctttgggacctcacccacttgggacaggcagggctctgaccacttactggaacacctgtaatcccagcacttgagctcagcacaataacaataggagatggctactaccgttaattttatgcagttacgatttaatactggatctttacgtttgtttacatttgtcccaactggcaccttcatcacctccaccctccccaccccagactatggtaaccacgattctactctctattttcacaagatccactcttttagctcccacatgtgagtgagaacatgtggtattgccctgcagtgtcacctatgttgatgcaaatgaaaatattcttttttatggccaaatagtattccattatgtatatataccactgaactgtacacttaaaaatggtaatgatggcaaattacatatgtatattttacatcaataaaaagaaacttaaaaataaggtaacaataggattctatgaaaaacaatcataacaaaacgtgctcataaaaattataaacacaatggtcaaaatagaaactcaatagaaagtactaagaatagataaaatctttcataaggtcaaacaaaatgtggttgagaatatagttgacccttgaacaatgtgggggttggggtactaaccccctgcacagtcaaaaatccatgtataacttttgactccctccaaattcaagtactaatgacctattgttgatcagaagccttatcaataacataaacaacaaatattttgtgtatgtattatatgctgtatattttcaataaagtaagctagagaaaggaaaatgttatttatacttttctctgcttcttgggagtacttccagcatcactagtggcactttatacgggtcccaagtatccttcaaagtttatggagagatgaaatgcttatgcagagatgattagcatcatgcagagttttcagtggatgcctgcagcactcgagctcagcacaataacaataggagatggctactaccgttaattttatgcagttgcgatttaatactggatctttacgtttgtttacatttgtcccaactgggaatggtgccatgtatggttgtaagtatgtaagtttttataaatttcaactttttataatagatttttgtatattttatggtaataaatgataaaatagtctagtatcaacatgtatatgtatatataagtgtgtatacatatatatatatattttttttttttttttttttgagacggagtcttgctgtcgcccaggctggagtgcagtggcgcaatctcagctcactgcaggctctgccccccggggttcacgccattctcctgcctcagcctcccgagtagctgggactacaggcgcccgccacctcgactggctaattttttgtatttttagtagagacggggtttcattgtgttagccaggatggtctcgatctcctgacctcgtgatccacccgccttggcctcccaaagtatatatatatattttttgagacggagtcttgttctgtcacccaggctggagtgcagtggcacaatctgagctcactgcaacttccccctcttgggttcaagcgattctcctgccccagcctcccaagtagctgggattacaggcatgtgccaccacgcccacctaatttttgtagttttagtagagatggggtttcaccatgtttgccaggccggtcttgaactcctgacctcgtgatctgcccgccttggcctcccaaagtgctgggattataagtgtgagccactgcatccggccatctccatatattttttgcattcataacatacctttttcttaatttttttgatatttttaccctatgtggtccatctgacagttttttcaaattgtcataaatttccaaaaaaatctcactatatttattgaaaaaaaactgcatataagtggactcatgcagttcaaacctgtattgttcaagagtcaactgtgtgttttaaagcagattttaacatcaagaaatgatagaaaaatgataagaattaaaagagataaatattcatattagaattgcccatcaggagcttctgagtagctgaacgcatggaggttcctggagagtggctggccccatgccccttcccacatacccttccttatatatgcatctcttccatctggcgtttataagaaaaggtgctgactgctgaattataaggacactgtggtctactagataaaggttgaggagaggggtttgggcttctattgtcttctttccgggccttcatctcctgcttgtgattaagtagtgcatgctgagtggagcaaagtggtggaataggactcttcagcaataatctcctcacagaaacatcaaggtaacaactcgatgcgtgaaattaccttcagaagagttaagaaaacctgaacccatgagcaagactgtgaagcccttttggactgcaaagacgagtaaaaccatagttgcacataaaggggattggttctttatgactgagaccccacccgcaagccactgcagtaccacaggcggaaagtcaccatggacccacggtttttacaccggaaaactctcccgtatggcctgagtgccctctgtggatctccactaattagtagcagagccagcatgagacttgcgtctaacctgggctcagggcgccctctcgtgctaaaaggaaatacaacagccagtcctttcactttctttttgatatggtctctgttgcctaggttggagtgcagtggtgcgatcatagattactgcagtcttgaactcctggctgggctcacacggtcttcccacctcagcctccagagtgggactacaggtgtgtgccactatgcctggctaaattttcgggttttgtgtgtggggtggggaagattggggtattgctatgttgctcaggctgggtctcgaactcctgacctaaagcaatcctccagcctcagcctcctaaagtgctaggttacaagtatgagccaccacactcagccccactcaatttctaaacgagctcactgaaatagagcagtcacaaacaaacccagactgtgaacatgagaataaatacctaattcttcaatgtgtagacagggatgcacatctgcaaagaataagaatagcctaagaaagacagcctcaacaaatgaacaaaaaatcgtgccagtgactaatcctaaagacatgcaggtgaatgatctggtagacaaagaattcaaaatagctattttaagaaaactcaacaaacttttataaaacacagagaaacaattcagaagtttatcaaagaaatttaacagagaaattgaaggaataaaaaaagtcagaaatcctggaactgaaaagtataataaaaaatgacacatgcaatacaagacatcagcaacagaattgatcaggcagaagaaaggatcagcaagctcaaagacaggttatccaaaaatacaatcaggaggggcttcaggatggttgactagatgcatctagtgttcatcccttccatggagaggaaccaaagtagcaagtagataattatactttgaataggtcatctaagagagaacactggaattcaacagagcagtgacaggaagcattgaaagcaagggaggagagagaaataaggcctgtttgcctgggattggctgggagtctggaacagcttcctaatgtggggaaaaggtaagagacccttagtgttcctcattttcaccaaggactcttgcaatcctagccacaggagagcgccttattccttgacagcacagagactagcatagggagttgcctaaagaccgtgtgaaggcattgcaacagagagctcacgctggattctgcaattctcccaagcagctgcagcacagcaccattttgagaacacagcccacacatcctgccctgctatgatggccgtgacttaggcaggagccctgagcagtgatcctgccccacccagcagaggagtgcccatgcattttcacatattccaagaacaaattccactacctacaaccactgctgctgcaggctgctgtggggccaaaacactagtgaaccttgtgctcccaagctacctgcctacagctactccctgagaaagcaaccccaccttcaccaagagcagggctatagcacagctactgctgcaccccaacctgagcattttgctagtgacctcggtatcaccccacccctgcatagcacaaccagcacctcacacaccaccaaggagcctgagggcaggttcacgtagcccagctctacctgcccccagtacccaagcatatcatccaggggcctagggatcacttagccctgtccaccactggtggcacctgagcacctcctggggtctgaggtcaggcccactcaacctgccactactgccacagttagcactcactgcatgcaccacttgagggtctggagactggccatgcgatccatagcagccacaaccaacgccagcacagaccacttgagattcaggttgtttcattgctatgattgccatcaaccatgccactttgctgcccaggaacttgagaacccacccacccatgtgatccatcaataccacttctggcacccaagtaaaccacttggaggcccacaaatcaacctgcctggacctaaaaccagtgcaatcatatgccaccatggtacaccaaagacaagcacactcagcccactgctgccaccattggggcctgaagacaggcctacctggcatcccacttctcagaaaaacttcaccacagcctccactaataaccacaccctaagccactgagaaaatcacaaatatcactgatgctgtttagaatcttatacagaggctactacattcaccgagaatcaaaaccgaagtgctctacccaagcaacaccacagatacatcttcaggaaaaagttctttcctacaaaagcaaattttaaaaattggaaaaagtgattattacaccagatgtgcagatatcaatgtaaggacacaggaaacatgaaaaatcaaggaactatgacactccaaaggagcacaataattctgtagcaagagatccaaataaaaaaaatttaagatgggtacaaaaaaatagaaagaatgaataagacctgctatttgatagcacaacatggtgactatagttaataataacttaattgtacattctaaaataaagagtgtaattggattgttaataactcaaaggataagtgcttgagggtatacatacctcattctccatgatgtgtttgtttcacatcacatgcctgtatcaaaacatctcatgtgttccataaatatatacacctactatgtatccacaaaataaaaaaatcatagtttacaagcaaaacagtatatgtgaccattggtttttaagtaaactggccaacatctctttaaaaatttatgaaatcctggaaaaataattccaaattttgatactaaataaactcagtgagatacaagagaattctgaaaaaaatacaaagaacacagaaaaacaattgaggctatgaaagagaaatttacccaagagatagatatcaaaaaagaaccaaacaaaaattctggaaccaaagaattcattgaatgaaatacaaaatagatttgaaaggttcaacaatagaccggaccaagcagaagagtatcagaactgaaatacagatcttttgaaataacccaatcagacaaaaataaagaaaaaagaattttaaaaaatgagcaaagatttcatgacatattaggcactataaagtgaccaaatatttgaatcttcagtgtcccagaaggcaaagagaaaatgaagaggttagaaagcctatttaatgaaatattagatgaaaaatttccaagtctaccaagagatttagacatctagataaagaaggctcaaaaatacccaaataaatacaatgcaaaaaggtcttctccagggcacattatagtcaaactatcaaaagtcaaagaaaaaaatttaaaaatagcaagagaaaagcatatagtcacctgtaaaggagccgctatcagactaactgtgaatttctcagcagaaactttacaagccaggagagaatgagagagagagaaaaaaaaaaaaaaacacctgccagccaaggatactgtacacagcaaaattatccttcataaatgaaagagagagaaaaatattttcagacaaaaaaaaactgaggaaattcattgcaacctgatctgctttacaggaaatgctaaagggagtttttcaaactgaaagaaaaaggtcctaatgtgtaacatgaaaacatctgaaggtataaaacccacaggtaaaagtaagtatcccgacaaattcagaattctctaacatggtaattgtagaacataaatcacttatatccttagtaggaagattaaaaaacaaaacagataaaaataattaccataacctgttaaagaataagcaatataaaaagatgtaaatgatgacatcaaaaacacaaaatttgggagtcgattttttaaaaaattttcttgcaatcaaaattaagttgttatcagttcaaactaacttgttataactataaggtattctgtgtaagcctcatggtaattacaaagcaaaaatttttataatagatacactaaaaataaaaagcaagggattaaaacatactgatagaagaatcacttaaccacaagggaagagattaagagaggaagaaaggaacaaaggatctacacaacaactagaaaacaagtaaaaatatggcactaccaagttcttacctatcaaaaattaccttgaatacaaatgggttaaattctccaactaaaagacatagagtgtttggttttttgttcttgcgatagtttactgagaatgatgatttccaatttcctccatgtccctacaaaggacatgaactcatcattttttatggctgcatagtattccatggtgtatatgtgccacattttcttaatccagtctatcattgttggacatttggaccgcatattctcactcataggtgggaattgaacaatgagatcacatggacacaggaaggggaatatcacactctgggaactgttgtggggtggggggaagggggagggatagcattaggagatatacctaatgctagatgacgagttagtgggtgcagtgcaccagcatggcacatgtatacatatgtaactaacctgcacaatgtgcacatgtaccctaaaacttaaagtataataaaaataaaaataaaaaaatttaaaaaaagacatagggtggctgaatgaatttttttttaaaaaaagatctaactacatactgcctaagagaaagactttacctgtaaggacacacatagactgaaagcgaagggatagaaacagatattccatgcacatgtaaacaaaaagaaagcaggaatagctatacttatatctgataaaatagacttcaagtcaaaaactataaaaagagacaaacagccagacgtggtggctcatgcctgtaatttcagcactttgggaggctgaggcgggtggatcacctgaagtcagaagttcgagaccagcctggccaaatggcgaaactccatctctactaaaaatacaaaaattaaccaagcatggtggcaggcgcctgtagtcccagctactcgggaggctgaggcaggagaatggcatgaacccgggaggcggagcttgcagtgagccgacattgcaccgctgcactccagcctgggcacacagcgagaatctgtcaaaaaaaaattgacaaacaaggccattatataatagtaaagaagttaatacaacaggagaatgtaacaagcataaatatatatacacccaacattggagcacctaaatatattaatgtttgatctttgtattttctagtctcattaaaagtaagggcaaaaactacaattacttttgcaccaacctaatataaagcaaacattaatagaccaagggggaaatgaagacagcaatgaaataatagtagaaaactttaacaccccactttcaccaatggacagatcatccagacaaaatatcaacaaagaaacactggacttgaactgcactgtagaccaaatagagcaaacagacatttacggaacattccatccaacagctacacagttcacattcttctcaactgcacatggaacattctccaggagattatacattaggccacaaagcaagtcttaactaacttttttaaaatgaagtatttttttcctgccaataatggaataaaactataaatcaacaacaggaggaacaactgtacaaatacatggaaattaaagaacatgcccctaaacaaacaatgggtcaatgaagaaattaaaggagaagttaaaaaatttcttgaaacaaatgaaaatggaaacataacatgccaaaacttatgggatacagcaaaagtagtccttaaagaaaagtttatagcaataaatgcctacatcaaaaaaaaatctcaaataaacaacctaatgatgcatctcatggaactagaaaaacaagaacaaacaaaaccccaaattattagaagaaatgaatgaatacagatgagagcacaaataatcaaaatagaaactaaaaaatacaaaagatcagtataatgagttagttagttctttgaaaagataaaaaaaagtcaataaacttttagccagactaagtgataataaagaagaaaaacagaaataaatcagacatgaaaaaggagacattacaactgataacacagaaatacaaagaattataagaaactactatgaacaactataagccaacaaattgaaaagcctagaagaaatggataaattcctggacacatacaacctaccaaggttgaatcaagaaaaaatggaaattttgaacaaatcaacaatgagcaacaagattgaagcaaaaatacaaagtctcccatcaaagaaaagttcagtacccaatggcttcactgctgaattctaccaaacatctaaagaactaataccaattcttcacaaactattcaaaaaattgaaaaggaagaaactcttccaaaattattttaggaggataatgatcattatcctgatcccaaaaccagacaaaagcacaataacaacaaacaactacaggccaatatcctcaacaaaatactagaaatagaattcaacagcacattaaaagatcatttaccatgatcaggtgggatttatcccagtgatgtaaggatggtttaacatatgcaaattaagaatgaaggacaaaaattatattatcattttaatagacacagtaaaggcatttgacaaaattcaatatcccttcatgataaaaactctcaacaaagtatagaaggagcatacctatatgataaacctacaaacaagatgaaactgagtggggaaaagttgaaagcttttcctttaagaactggaataagacaagcatatccaccctcaccacttctattcaacacagtactggaagtcctagccagagcaattaggcaagacatccaaattggaaagaaggaagtcaaattgtccctgtttggccaggctcaatggcttatgcctgtaatcccagaactttgggaggccaaggcgggcagatcacttgatgtccagagttcgagaccagcctggcaatatggtgaaaccccatctctactaaaaatacacacacacacacacacacacacacatgctagccagacatggtggtgcgctcctgtagtcccagctactcgagaggctgaagcaggagaatcactagaaccccagaggcggagcttgtggtgagccaagatcgcaccactgcactgcagcctgggcaacagagtgaaacactgtctcgaaacaaaaacaaaaacaaacaaaacaaattgtccctgtttgcagaagacatgatcttatatatagaaaactgccaaaactacaccaaaaaactgttagagctagtaaatgaatgtagtaaacttgtagtctacaaaatcaacatacaataattgatagcatgtctatatgccaacagtgaacaatctgaaaaagcaatcaagaaagcaatcacgtttacaatagctacaaaaaatgtccagaaataaattaaccaaggaagtgaaagatctctataatgaaaactataaaatattgatgaaagaaattgaataagacacaaataaatggaaagatatttcatgttcatggattgaagaattaatattattaaagccaaagcaatctacagattcaatgcaattcctatcaaaattccaatgtcattcttcacagaaatagaaaaacaatcctaagatttgtgtggaaccacaaaaaatcccaaagagccaaagaagtcttgagcaaaaagaataaacctggaggcatcacactacctgatttcaaattatactacaaagttatagtaaccaaaacagcattgtgttgacataaaaacagacatatagaccaatagaacaaaatagagagcccagaaatacacccaaacatttaaagccaactgattttctacgaagttggcaagaatacatgatgggtaaagaacagtcttttcaataaatggtgctgggaaaactggatatccatatgcaaaagaatgaacctagaccccctatctctcaccacgtatgaaagtcaaataggccaggcacagtggctcatgcctgtaatcccagcactttgggaggccaaggcaggcagatcacttggggtcaggagtttgagaccggcctggccaacatggtgaaaccccgtctttactaaaaatacaaaattagccaggtgtggtggcacacctgtagtcccagcaacttgggaggctgaggcaggagaatcacttgaaccccagaggtggaggctgcagtgagcctagatcgtgctattgcactccagcctgggcaacagagtgagactctgtctcaaaaaaaaaaaaaaaaaaaaaaaaaagaaagacagaaagaaaagaaaagaacaatagattaaggaattaaatttaagacctgaaactctgaaattattagaagaaaacatagtgtaagcatttcatgacatcaatttgggcaagaatttgttagacaagacctcaaaatcatgagtaacaaaagcaaaaataaagaaattggattacatcaaactagaaagcttctgcacagcaaaggaaacaatcaacagagtgaagagacaacctatagaatgggagaaaatatttgcagattatacatctgacaagggattgatatctagaatatataaggaactcaaacaactcaatagcaaaagtccaaataatcctattaaaaatgaacaaaagacctgaatagacatttctccaaaagagacctacaaatggccaacaggtatatgaaaaatgctcaacatcactaaccatcaggaaaattaaaatcaaaactacaatgagatatcacttacccctgttagaatgactattataaaaaagacaaaataacaagtgctagcaaggatgtggagacaaagaaacccttatacactgttggtgggaatataaattagttaagccattagagataatggtatagagatgcctcaaaaattaaaaatagatctatcatattttctagcaatcccactactgggtatataccaaaaagaaatgaaatcagcatgttgaagaaacatctgcatccccatgtttatgacagcattattcacaatagtcaagatataaaatcaacttaaatgcccatcaatggatgaatggataaagaaactgtgatatagatacacaatggaatactattcatccatttaaaaaagatgaaatcctgtcattttcaacaacgtggatgagcctggaggacattatgttaagtgaaataagccaggcagagaaagacaaatactccatgatctcagtcctatgtacaatctttaaaatttgatctcatagtagttgagattagtgattctaggaagataagggggaagtgggagatggggagagattggtcaatgggtacaatgttacaggtagatagaaggaataagttctggtactctattgcacagtagggtgacaatagccaacaataatatattgtatatttcaaatagaagagaggattttgaatggtctcacaacaaagaaatgacaaacatttaaggtgatggatatgataattaccctgatttgaataattacacaatgtatacatgtattgaaacatcacattgtacccataaatttgtagaattatttatgtgtcaataaaaagtaatacagttaaaaaaataaaattgcccattaggataaataaaaagacccacacacaaaattatcattgtggcatttcagagcacagagagaagatacttaaagcttcttctgagaggaacaggacgcatacaaaagaatgggaattagactggcgatataattaagcaatattgtaaaagatctaagggaaaaattatttggaacctagaatttttagtcaaactatgaatcaattttgggggaagaaaaaagacattttcatatatagagggccttaatagtcactgaatgtgtactatagtaaaaccagaaactacataaaagaggaatttgggagattcagcaacccaagagaataatgaagtatgagggggatgttttctccttagttcttttccgtatttttcaataatttgataataaacatgcataattttataattaaaaaggaaattaattttgacaacatgcaagttcctgttctcacataccttatagtggagggacagattgtagtcaaataagcataataatacatgcaaaattacaaactgagcattactctgaaggaaaattacataattctatgtaagcctataatacaggaatctgacctagactggggaatcagagaaggcttccctaagcaagtaccccttgaacttagctttgaaactgggaaaatgaggcaatgtgagatgaagctgttagaggtattaggaatcaaacctattggggccttctagtccttagtagagagtctggactttattctatgtggaatgacagcctccagtgggttttaggctggcggatactacaatcagatctggaatgcagaaatagtacaccagtttctttgtgggtaaaagtcttagaggggagaatatgaccaactgtagggagacctgtaaaaaaagtttatcagtagctcagacgagataatggtaacttggattaagatagtggtagtagtaacagtgaaaaactagatacatttgaaagcttttagagccaaaataggaggcagctgtgcccttgttgttaccagtgtgggatctgaacacatgactacttgggttcaaatactgagcaaattaattaacctctctgggcatccgtttcctctcctgcaagacatggatgataatggtttctacattcatagggttgttatgaggaatgaatgaattaaaacttgtaaaatactttggacagtgcttgacataaaacaagtgctcaatacatattagctattattgattatattgccctggtcagtgtcaaactgcatatgggagatgagaatggtaacaaggataactctcacttgcatattcaaatgcaggatgctgccattcactgttataaaaaactctggaagagaatgaagtgatgaaaattgtaaatttggttttgaacatgtgggttttttgagatatctaggtggagatgttgagaaagtgattggctgtatgagcctggagttccagaagaggtcagcaggggagacagaagaaggagcagtctgagaagtaggagaaaaaaacccacagagatgttggcacagaggccaagggaagagagagttttaaaaacgaatgaatggtcaacaggtgcaaataaagactgaaaaatgtccattggatttagcagcatgatggtgattggtgaccttggcaagagctgttggtttgatagtagcccaatgttcttgataaatttgtttacaagtcaaggtagcaataaagtgtctaaagtcaatttgtccattctgtcctagcaagtgttttccatttcagattctctacttcatagccataggtgtcttattcctactttacaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatggtaatatcttggatctttaaaatgaatattataaatatccagtcctacttttaataaaatttactggacaatgtacaggaatatagtgtgttgctgaaggggacattatagagttactgtattagacctcagccaagatcccctagtttccagcttccagtgtaaagtttttaccttgactataaaagggcttgagtattagtaggactcatggatttttagttaaatgtctgtgatggagaaaagatggcttatggatgattgaggtgggaaaatgaggagaatagtatgcccttggtttctcagccttatcccattaattacgctccaatattatggagagaggaactgcaagttgtagctgaagagattttttttttttttggagaaatctagggaaatgggaaaaaaaggcattgtccagattgcaactgtaagggctccactatatcattagtaatgcccagagcagtaaatagcaaatatgacaggctattgtagagcttgacttcagacaccagacagccagaggcactctgtagatacctggcagtagatgagagacacctgtgaaactgagggcaggtcaggagctagtgaattttagaagtaacatgggattgaaaggactatttggtgggaactttggaaagggtcaaaggttctgtgtaagcaaattaggacgatggtaactacagttttaaattattgttaatgtaactttatttgtaactgctagttgtgcaaattcagattgcatcatcatttcaccccaattttccttacttttgtatttattctgctaactcttaatcttggatcaacctaataaccctctttctctacccctctcgtggccattgaaggctcttagtcagtttgtgctgcaataacagtataccacagaatgggtaatttataatggacagaaatttattggctcacatttctgggggctgggaggtccaatatcaagttgcctttttctgcgtcttaacatggtggaaggcattatatgacaaaagggcaaagaaagggtgagagagagcaagaggagggtgagctcactcctgtgataacaaatccactcccatgaacactttccccagataactgcattagtccattcatgagggtggaacgcttatgacctaaacaccttttatatgttcacctctcaataccatcacgatgataattaaatttcaatatgagtttcggaggggacagacattcaaaccatagcaagagttattggagaaaaatgtcggagaggcctaatcttttatatttaatagcatttctttcttcctattactctcatattaaccttctcctcaggttccttggttgacttagaaaagagaattgatcttgccatgcatccaccattttcctccttatgttctattagtgaccttgtttattgtcttctgtagtgattaagaatagaaatctctcttccccatgtgtcacataatatttatggaattttgacaagaccttagtggacaaaatgtgtcatactgaatgagtaacaggaagttgatgcacaaacaacattcttgcaggcacagaggaataggtcatttacttgtatatgatcattgtcaatcaatcattgtccagttggaccccgattcagtttattttttgttttgtttttctccttttcacagattctatccactaattttaatctttatttttcagaaaaaaatgctttatcttattgaacctcagaccaaacactttgtttttcgatgcagactgagttatgtttaaggctacatgaaccccagactagttgtttgctgctcctaaaaccttccctgttcctcataatcaagtaaacaggtctcccttcttagaagtatttgatcttcaaaattgccctgtggtataaatagggcaggaattattattatccattttacaaagcatgaagatgagactgagaatgttgaatacatttgccatagggtttacaactagtcacaggcagacatgctcttaaaatatatatctccttgattttaagttgtatcttgtcatggttttatgaacttggaacatgtcttaaagtttatatctacactaacatttttcccaataagctgttattaaatcaatgatttgtggcaagaagggatagtgatgtggaaagggggggtacttaggggagagcctggaaggcctaataagagagaaagaagtcataaaagttaaggcaagtgatatggtttggatatttatcttcactgaaatctcatgttgaattgtaatttccaatgctggaggtggggtctggtggcagatgtttggatcatgggggtgaatccctcatggcttgatgctgtcttcatgatatttggtcattcagaagtgtgtggcaacttgcactctctgtcttgctcctgctttcaccatgtgacatgtctcctcccccttcacctacccccatgattgtaagcttcctgagacctccctgaagccaagcagatgccagcaccatgcttcccatatagcctgcagaaacatgagccaattcaatctcttttctttataaattacctagtctctggtatagaacagcctaatatagcaagacactctgacattgtttggtttgtctgactccagatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacaggtaagcactttttgactattggtactctctcttccccatactcaaaaagttcttaccagttattcaaaccaacaaatcctgaagccatgtttaaggttaggtacaggtatggaatcaaatggcaagggtattaacatttggaaactaacatagctgagcatcagagaagcttgtatttttctcactccttgccttgattgaatcatataagctgttttagagttggatttgagcctacctagaatttttcttcccaacctctcatctttttttctcttatacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttggtaagttgaagaaaagatttaaggtcaggtaagaagaaaaagtctggagagttttgagtttctaaaatacctcataattcagccttgtctccaatggacatgatcttttaaaagctataaatgttacacaaataatagctgattgtatgtatttaaagtttgagtatatagaataaaaatttaatgtcacccactaaactcgacactcctttgaaatactgcttagactttgatacatatccttccagatctttctccattaattatgtcatataggagtcagcagactatggcctgtgaaccaaatttggcttgtggcctgcttttgaacagtccatgagcttagatgagattttacatttttaaaatattgcaaagaaaagaaaggaggatgggaggaaggggaggagaaggcggaggagcaagagaatatgtgacagaggctagatagggctcacaaattttagagtacttactatccagccttttccaaaaaatgcttgcttgctcctgatctaggatattaagaatgagtatggtgtaagtaacagaatactcaatggacagtggtttaaataaataagggtttattttcttcacaagaaatttgaagattggtcgttggttccataaattcagccgctgaagaatgtcatgaagaacactggtttttagatatggagttttgttagatactgccaaactgactttcagcaattttgtaccaatttatatcccctaccataagtatatgactgcccttttccccacaccattgccaacaacatatattataaaccttcagaaaattttccaatttgatgagcaaaatgtttatatgttgtcttcatttgcatttccctggttagtggtcaaattgtatattgtttcatgtttgttggctatttgtataactccctctgtgaattgcctgcttgtaaattttgtccagttttctatttggtcagtcatcttttgcttatgtatttgtaaaaggtctttatagattatggatattgacacattgttatttatctttcaaatgttttcctcacattgtcacttgtactttaactcctttatgatattttttgtccttcaaagatttttcatctttatatagtcaaaacctcctatcttttatcaatcttttcatttatatgtctctggatctttttcacttatgttttctgcctgagaatgtctttgccacccccaagacactacaaaaatagtctatattttattctcttacttgtatagctttatttttacagtgagcaatctaattgccctggaagttacttttgaatgtagtgcataattcaaatagaaattttcccaaatggcagctgacacaaccaatccttttttcattaatttgaaaatgtcttctttatcatatactaaattgctaaaatctgggatttttaattctccttaactaatctgttaccaccctgttttaatgacttcaactttgtgatatgtttgatatctgtatgacatcttctttcattgtacttcttcaaaatttttattagctattattgtacaatttttcttcataaattttgtgtacgtattttttctatttttcattttttgaagattgtataattttattttttattcattaatttttaaaatgcataatgacacaataattttacatatttatagggtactttttgtgtattttgagttacttttactggctaatttaaaaatagataaacaagagcatgcaataaaatgtaaattttcctccctcttggacttccaaccccatagtctgacagacagtcattgctgtgggtttgtatactcccctccagaagtagtgcatacatgtacaaatgtgtgtgtgtatgtgtgtgtgtgtgtgcatttcacacaaaaacaagagcagtgtaaattggtctgtaccttgatttttaaaaggtaacaatatattttgaattagccaggcatggtggcacatgcctgtagtcccagctactctggaggctgaggcaggagaatcgctcgaatctgggaggcggaggttgcagtgagctgagatcgcaccactgcactccaccctgggcaacagagtgagactctgtctcaaaaaaaaaaaaagtaacaatatattttggatatcatttcatgtcaacatatatagatctaccccattctttgatttattcaggttatactctggataccatgctgaatcctacacttaaacattacctcaaaatggatcaaagataaaatgtaagagctaaaactacaaaattataagaaaacaacaggataaatctttgtgatcttgaattagacaatagtttattggataggacaccaaaaccaacaagcaacaaaagaaaaaccatttgacccagccatcccattactaggtatatacccaaaggaatataaatcatgctgctataaagacacatgcacacgtatgtttattgcggcactactcacaatagcaaagacttggaaccaacccaaatatccaacaatgatagactgattaagaaaatgtggcacatatacaccatggaatactatgcagccataaaaaatgtccccgtttgcagatgacatgattgtatatctagaaaacaccattgtctcagcccaaaatctccttaagctgataagcaacttcagcaaagtctcaggatacaaaatcaatgtgcaaaaatcacaaacattcttatacaccaataacagacagagagccaaatcatgagtgaactcccattcacaattgcttcaaagagaataaaatacctaggaatccaacttacaagggatatgaaggacctcttcaaggagacctacaaaccactgctcaacgaaataaaagaggacacaaacaaatggaagaacattccatgctcatggataggaagaatgactgggttttaagacaagagcagaagtggaagttgcatttttatcctcatatcacacacctcagatctggaggtgggattgatattttcagggttcttcgctgcagcttccatgttattgctcttccattctctctctctctctctctctctctctcgtctctgtctctctctctctctcttgagatagggtctcattctgtcacccaggctggagtgctgtggtgtgatcacagctcactactgcagcctcaacttcctgggctgaagtgatcctcccacctcagcctcccaagtagctggtactataggcatgcaccaccacgcctagctaatttttttattttttgtagagatgaggtctcactgtgttacccaggctggtcttgaagtcctgggctcaaacgatcctcctgcctcagcctcccaaagtgctggcatgagccactgcacctaggcctttgttttcttttaaagctggtgcaatcaggcaataccacctgctacccttgcttaatactgtaatcaactgtcctcttggtcatgcctgctcatgcactgaagattttatctcctgaaacactgtctctttctctattatcagtgaatttaatgcccaaatagtaataaaggctgagaggaagcagtgtcctcaccaggcatctaaatttcaattagtgtgagaaggtgcagagaatacttcctgaagcaattgaaacaatttttaaagaagtggaaaggggcctttagagagaaacctaagtactgtcagccctctacattgtcaactgaagaatcctaagtttgtaaatttggagtggaaagggttgcaggctgggaagtgtagcctctggcagcaaatggaagcaagcactttgaagaaggaaggatgagataagaatttatgctgaatgagttggctaagtatacatatttaacaggttccaggaggagctgtgaatatttatgatggggcacctgcaaccacacatgttacatacattccatgttcactttggggtggagacttaacatttagatgcatgaaaattaggctgtatatgtcaaaagatgaaacagaggacacagaggcagcctctgtaaactggccagagccagtccatggtcagtggtctctcatcaggaagcaatgcttctcggttgttatgataaaactgcacaaagggaggggaatccaccacgtctttagaaaggactggtttatgtttaacccttaagaaagaaagtctaacggcagattagggagggagggaatgtaacaaggcatgcccgatctcccatcccatcatggtcagaaactcagtttttaagccatctctggggtctccttggccgagaaaggggtctcttcagtcgtttggggatgcttaagattttatttttatttttcagtatcactggatttctagtctcatattcaaacaaccattgattgaaagtattcaaaaaacaaccccaaaacaataaaagataataatacaacaataaacaataatacaaagaaacaatacggtaaaacaactatttacatagcatttatgttatattatgtactgtaagaaatctagagacgagttaaagtacatgagaggatgtgcatatgttatatgcaaatactacatcattttgagtaagagacttgagcatcacagattgtggtatctgcaggggtcctggaaccaatcctccatgcatgccaaggaacaatttcatgaaaagaccaaatattttgagttttatctagcctcaaattactataatgtagatagaggccacttttatttatctggagttagaccacagttttcttgttgatcctagtcgttttaggatttgatcttagatctcgcttatactttcagattatatttaagaatcaagcaagcagaccatataacatctaccctcacggaatcactgatgtccgtcctttgtattcaaggagattaccaaaaggtaaatattccctcgatttatagctcttttttacctgtagatacagatgagataaatatcatcaataacaactaaaattatgttggtcctttctccagctgttggccggacctcaagctccagtctaaagttataaaaatcaattataggaatcctcaggtgatgtttcatgtaaattcgtgaagagtcgcctgacatgtttttcctattacctagcggtgatgttcaaatattccacagccaattagattccactgcaattggttccactgcaactactgtaaatgccctaaaatcttgaagctggttcttctggcacttaagataatttttttttctgagtacggttttcagctacattccacacttttggtatctagtgtggtattccacactttgggtaactagtttgatattttcaggattctttgctgcagcttccatgttattgctcttccttgctctctctctctctctctctcaacagggtttcactctcacttttggtatctagtttgatattttcagggttcttcgcatattcatttctaaatagttcacaactccagtttttatttactatattgtttgctgtttaaagatttattttttcttttagtagattggatgttatgtatattctttctattatttaattttggatgaatatttatcaaaataatagatgtgtatgcttaaaactacaaaagggctgcctccctagaggcatccatttttaagaatttctgtttttgatttttggtggttatctctacatctctaaaaagttacttatactgctaactctttgtttttcaactttagacattatatacttactttgttttgtgcttttttccattcaagttgtttcagttttatcagtgttttcagttggattggctatcattagaactttaaaaatatactaaacatcaacttttagtaagatattttccaatcatggattgaaaatatcttttgactccatacttcataaattaaggatattaaaaactgtacccctcacttttcctttccccaaacctttcttttctctactgctgctagccattcctttacttttacaaaactaaacttgataacatttacattttgtgctgtaatttgaaataactcttccttgctttgtctatatattttctctaaagcttaaaaaattaaaaaacagcatttgtattattttagtattttagcaagtttcttttcataaatgttaactgcagaactgggtaatatgctatgattgctctcttttctacagctcaagtgattttactattaagataaaataatatgtggaaggaaaaaagttgatctcatagaagtagagataaaatagtggttactagaggctaaagaggggaaggggagggggaaatagggagacgttggttaatggatgcaaaattccagctagataggaggcataagtcctaatgttctatagcactgtagggtgactgtagtcaacaatgacatctattttcaaatagctagatgagaggatttggaatgttcccaacacaaaggtgtatcctgaagtaagactttgttttcttttattcggaaaagaaatgtaggcttcttcaaccctatttcttaggcctttcagcttcttaatcattctatgtattgcttgctatccaaatcttttattttttttttgagacagcgtctcgctctgtcacccaggctggagtacagtggcacgatcttggctcactgcaacctctgcctcccaggctcaggctatcctcccacttcagcctcctgagtagttgggaccacagacgcacactaccatgcccagctaattttttttattatttttattttttgtagaaatggggtgttaacttgttgcccagactggtgtcgaactcctgagctcaagcgatctgcctgcctcagcctcccaaagtgctggaaccaaatctttttcttcttaaagacattcttgtagtgaatagcattaactacttttcccttgtacatttctattttttgatttcttcttttgtttttctggaagtatattctcaagtaacttctaaatatgtggtacatagagggtgaactttctgaatccttcagtatcacatgatgggcagacagactggttataaaaattttcccgctgggtgcggtggctcacgcctgtaatcccagcactttgggaggccgaggcgggcagatcacttgaggtcaggagttcaagaccagcttggccaacatggtgaaaacccatctctactaaaaatacaaaaaaaatagccgggcattgtggcgtgtgcctgtaatcccagctactcaggaggctgaggcaggagaattgcttgaaactgggaggtgaaggttgcagtgagccaagatcaccccactgcactccagcctgggcaacagagcaagactgcatctcaaaaaaaattccttcccctgttttctaatattcattattgccgataagaattctttatttgcatttctttatggaagaatggcatagtgacagagttctggggagattttgaatgtgtgtcccgaaatttggaggcatacgtggatagttactggtaacctgcttttccatggagaattttgaaggctgtaatgcccataatagtgggcaagaagagagggcaagagtggagcagtttaccttcctgctgtttgacatgagtttattctgtaacaagtgaatactgttgaaagtagctgggctttatcccttttgaagatattctacccaagaaggcagttaggcaggctgaggggatagcagaaccaatagagtcttggatatatcactggaagtaagaagagctgatggggagaggagagttgcagaaggatagctgaaagaaacatctctcatgtcatggaactatgtaatgctgaggtccccatggtaactctaaagaaaccatacatgtgtcctatgaaaagaccagcatttgggcacctcccacacagagaacattgatgaccaaatagtgttgtcaaagatagagcagcaggacctgttaaacaagagtctgtttgccctttcttctattacctaccctccctcacccccagctcctggaaaagggaagagaaggctcagaaatattgaaagaacatactacaccattccctttctttctttctttcttttttttttttttttggagacagagtctcgctctatcccccaggctggagtgcattggcatgatatcggctcaacctctgcctcccaggttcaagcaattctcatgcctcagcctcccaagtagctgggattacaagtgcctgccaccacacctggctaatttttgtatttttagtagagatggcgtttcaccatgttgaccaggctggtctcgaactcctcacctcaacaccattccctttctatggatcctctaaccataggtcaggcataacttactgaggtgaggaagagcttagaatgaatataaaattaaaattttgatttagattgtatcttcaggtatgaaacatacccagaatgagacttaattactaaaatcagttcttgtcctgaggacccattaccctgagggcagatctcagttcttgctccctttcctcacagaagtcagagactacaccttaaaactccaatgccaagctctttggcatatattcaggcctgacactttcacagtcaaccggataatcaattacagctttttactttttaaaaaaattgtttgaatcttaaaattataataggtgcgactttagcttccacttgctcagaaacttcatatgtacatacagatttgtagaacccttgcaacaacaacatgattatcaatatgtggcttgttgtactctaattgagctatttatggttttgcttgtgggtaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccaggtgagttcttgcctttccaagtgctgggtttcattctcagtgtatgtccccttataacctgaagaaaatataatggtttgcaatataggtcagtaaaagaaatgagcttagcttttactaaatttgagtttcacgtagtaaacgtgcctgctggatggataggccatagaatgtaggccctagatttttcctatagtactcattcccagtctgggatttagctctctctagctgatcctccccatttttatatgtccaattaccacctattttcagatgacccacagatttatatctacagcctagatttcttccatggacatctcattatgggtgactcaaaagtacctcaaaattaacatgtctgcagcatgtagcactgttgcaggaagtcagggaccccgaacagagggactggctgaagccacggcagaagaacataaattgtgaagatttcgtggacatttattagttccccaaattaatacttttataatttcttacgcctgtctttactgcgatctctgaacataaattgtgaagatttcatggacatttatcacttccccaaccaatactcttataatttcctatgcctgtctttactttaatctcttaatcctgtcatcttcataagctgaggatgtatgttgcctcaagaccctgtgatgattgcgttatctgcacaaattgtttgtaaagcttgtgtgtttgaacaatatgaaatctgggcaccttgaaaagaacaggataacagcgatttccagggaacaagggagataaccataaagtctgactgcctgcagggccaggcagaacagagtcatatttctcttcttgcaaaagcgaataggagaaatatcactgaattctttttctcagcaaggaacagccctgggaaaagaatgcattcccagggggaggcctctaaaatggccgctctgggagtgtttatcttatgcagttgaagataagggataaaatatgccctggtctcctgcagtgcccccaggcttgctaggattaggaaattccagcctggtgaattctagtcagaccagttctctgctcttgaaccctgtttcctgttaagatgtttatcaatgacaatgcatgcacagcaggacatggaacctcattagtaattctaatttcgccctaccttgtgatcttgctctgtccctatttgccttgtgatattttattgcctttgaatcatgtgatctttgtgacccacaccctattcgtacactccctcccctttgaaaatcactaataaaaacttgctggttttgcggcttgggggcatcacagaacctgccgacatgtgatgtcacccctggagacccagctgtaaaatttctctcttttgtactctttctctttatttcccagaccggccgacacttaggtaaaatagaaaagaacctatgttgaaatattgggggctagttcccacaatatagcacagtgcatctcacttagtaagagcttaataggctacgtgcggtggctcacgcctgtaatctcagcactttgggaggccgagacaggaggattgcttgagctcaggatttcaagaccatcctgggcaaaatagtaagaccttgtctacaaaaaaaaaaaaaaaaaaaaaaaattagctgggcatggtggtgtgtgcctgtagtcccacctactcaggaggctgaggtgggaagatagcttgagcccaggaggtcgaggctgcagtgagcctggatgacaaagcgacaccctgtctcaaaaaaaaaaaaaaaaaaaaaaaaaaaagcttaataaatacttttgggcaaaacatagggaaagatataaaatatttcaaaatatggctagaatttggaccatttctactgctttaaaaaataaagctaaattctctgaacaagaaaagcttagttcttcacaaaaactcattgctcggccccagaataactcagtgccatattgctgaggcttgactacatgtccatttgattatatttatgatacataagatccctactagtctgaaaacatttcatatgtttagagagtaaagtatatgaactttggtgccaataaaacacatggcacataaactcagagaagtataaattttgccaagtacttgtcctgaccgatttttcctaactatagttttttcgtcacttttgggaagagaactgaaatattattctatattctccaatctcctctcttcagtattttggtttatatagctataggttataaaaaatgaggtttatacatattagtgaggtttacatatgaaatcttagcagatccaattagcaagcgactaattcataaatctggttcatatacaaaatgctcttctgaaaaaaatttgaatgttttaaacagaaaatttaaggtattagtgttgtttgacatttttgtggttcaccttatctttcttatttgatttctgtttttctatttttaattttttatagccttgtggaaggtcagttgctagatggaagtttaggaaagtcagtatctcatttgacttaactaacttaagaaaggcactgaataaccacttggttctttaaggagttaaatcttctaatctgaacatgaagagaataaggctacagactgtaccaaataaatcagctagcatatggccttgggtgcagaaaaaactaagttcagtgggatcagtcaccctcttgtcctggggacacatttgttgtaagcatatactcactgctcatagcacccaccctcaactcccaagccctggtacatgcctaagaggaaatggaattaaaccaatggattagatatatcacatgcatgccatcgctttcatcatagactgctagctcctacctgacaacatcagtagcatttctttacccctttcaatatatgtaattaacagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagtgagtaaagcagcacttaagtccagtgggtggtgaataaagaaaaattgatgtaatcaaagtgatgtccagataatgaatgaattgtatgtgcacataaatttaacaattatgttacctataaatgtataatttttactcaaacacacgtgatcatataacccatattttaaaaatccagtcaccattttttcctttcaatatttacttgatttccctctcccttttaattccctatctccttctatattacatcttttcaccaaccattccatgcccaggtaacatattttaagacatattttctctataattatataatcatatataaacacatacatacattgtattagtcttctagtgctgccataacaaagtactgcagactgggtggcttaaccagcagatatctattgtcttacaactctggaggcttgagatcaggatgtgggcaacgttggtttcttctgaggcttctctccttgtcttgtagatggctttctcccttgtcttcacatggtttctcctttatatatctttgtcctaatctcctcttctaataaagataccagtattgttgggctagggcccaccgtaatgaccttattttaactaactacctatttaaaaacactatctccaggtatagtcacatgctgaggtactggggtttaggactgcaaggtataaatttgggatgggggaacacaattcagcccattgcatacatacacatgtgtatatatttatatataccacaaatctgaatggtcaaaaatatggtaaaaaattccaattgcactatcctacagggaaatgcgaaatagaataacaataggatagcactttatacccatcaaactgccaaaattataattactagtgggcttgtggataaaagagtgttctcatgctatattagtggataagtagtatagtcttttcaaaaccaatatatgccttttgaaattctgattattaagatgtttaagatggagtgagccacatttccctgtgtgtcccactggatgcaactaaaaatcctgaacaggccgggcacagtggctcacgcctgtaatcccagcactttgggaggccgaggcaggcggatcacgaggtcaggagatcgagaccatcctggctaacatagtgaaaccccgtctctactaaaaatacaaaaaattagccgggcatggtggcggccgcctgtagtcccagctactcaggaggctgaggcaggagaatggcgtgaacccggaaggcggagactgcagtgagccaagatcgtgccactgcactccaggccggcgacagagtgagactccgtttcaaaaaaaaaaaaaaaaaatcctgaacgaaatgcatgggaaccttgaaaagttataatgtgagttatactcacctaccagaatgtggcatatgttacaattctatgcccctcctctcaaagctttagccctttaactttgggttgagcctcatatttagcttgaatttctagtaatagtgatatattattctccagagttaaagtcctttactatccattattctaaaaattttaaggttgtttagtcctttgagttgcatttttattttttacatagttcagggtattgctttccttctgaaggattcagatttcacatttgtgcaagagtctaatgcttagtatttaattctagtggcacagagctttttcttttctccctcttctctccagcctcatggctttggtttagaattccttcagcctgatagaatattgtattttataatttccttattgtgctatttactagatatttgttcttctatttttttctattcataatttctccctttcccaccacatctttttccaagtaggatgtgcacttgccacagtatctggacagttaaactgtctcattttcttggagacggtgatgaaaactagagagatatagtgacataagcagagccagaaaacaatttcactgaagatgatatatattttttttcctctgggatttctaatatagcttttggtggagataagagtctggaattgagaaagaagagattggaattgagaaaaagagtctgagaaagcacagggagagacacaaaggcagagaccaagagacacaggggaaggatcttcagaggaagagtccagggagaaagatgctaagacagagggataagaaaagaagaaaaaaaaggaccaggaggagagagacccaaaccataaatcactcctatttccattagcagtaaaattgataatctattttcatacaatgaaataccatgtgacaatgaagattcacaaaaataaagctatacacaacaatatgaataagtatcacaaagacaatttttagtaaaatggtaagtgtcaaaagaatatatacagtattatattatttacataaagttcaaaaatgggcaaaattaacttatatagtttagggatacagaggaagaaaagtataaaggttagtaaggacatgattataataaaagacaagatagtggctacctcttagaaagagttcatttgagaataaacacatgtgttttgtggggatagcagcaatattgtatttcatgacctagatgtttgttttataattttgtgttttaaaaaattgtaggatttatgatttatttcgtagatggatcctacaaatgatagggaaattgcagtaggaatgaagaggaaggaacatgtacaggatttgtttagaagatagaaggcacatgattttgtaaataattagctatgtttggtaaaggactaagaggattcaaagatgattaccaaatttctgatatgggtaactagaagaagagtgagacaaaatggaagaaagtgtatttaaagaaatgatagcaaaaactttccaaatctggagaaagatgtaaatatccacgtacaagaagctcaaagatctctagtcagattagattcaaacaagactatatgaagacacgttacaatcaaactgtcaaatatcaaagacaaagagagaatcctgaaagcaacaacaaaaaagaagcaaaccacatacaaggaaattccaataaggcagaaactttacaggtcagaagagggtgggatgatatattccgagtactgggaaaactttacctagaaaatgtttccttcagaaatgcagagagataaagactttgccacacaattccagttagacaagagaaataaattaaagacatctattgtacactatggtgactacagttaataaattacccattccaatatatacatatataaacattgtgatgtacatcataatatattctatttttccctgtcaattaaaaaataaatttaaaaagattggatagagaagaatcagccattctagtaattaagcctgaggaagcttacattccagtgatttcagataaccattatgcaagttaaggaataaactggataggatgatattaaaaaaacaaaaccaccaatgagatacaccagaatggctaaaattaaaaaggctgtccataccaagtattggtaaagatgtagagtaatgagaactctcataaatttctggtcaggaaatccaaacatcgaaagccaaacatcggcataccctattgactcaggaaatccactcctagtatacacctgttatgtcctgaatcatgtcccctagaattaatatgctgaagccctaacactagtatttcagaatgtgactgtatttggagatagggtctttaaggggtttattaagttaaaatgaggttgttacaatgggccctaatccaatatgactagtgtccttataagaagaggaaatgtgggccaggcacagtggctcacgcctgtaatcccagcattttgggaggccaaggcgggcggatcacgaggtcaagagatcgagaccatcctggccaacatggtgaaaccccatctctactgaaaatacaaaaattagctggacatggtggcgagctcctgtagtcccagctactcgggagactgaggcagaagattgcttgaacccaggaggtggaggttgcagtgagcagagatcacgccactgcactccagactggcagacagaccgagactccatttgaaaaaaaaaaagaagaggaaatgtgtacacacagagacaccagggatgcatattcacagaggaaagaccaagccaaggagaggtgtcagtaaaaaccaaacctgccaataccttgatcttggaattttagtgttcaaaactgtgagaaaacacattcctgttatttacacctcccagtctgtggtatattgttatggcaaccctagccactagtacagcacccaaaagtagtgtgtacatatttcacaaaagacatgtaactatttaatccatgtggagtgtcaaaaggcaaaaatacaacaaatgtattttaaagattgtaattggcttttatacatgattctagaatcagatagccctcagaaccaaatacagaacagcagccagcaacatagtatggatagaaattggaagtgaggtttagagacagcttaattgattacagttgggcatttttgccttatttgaagctgttagtcgcctgcaattgatggaagttcagctgctataatcggctgagactgagctgtttgttataaaagcatattcctaaattaggctttcagttagttcatcaactaagccaggctgcaactttgttgtgcaaggactcaagtgcaaaggtacccttaggcaaaattcagattaatttaaaaggactttacttttgttagttatgtgaaatgaagtggaatctattttttccaagtggatagtcatattttctattatcatttaccaactagctgatttttttcctgtactggttggagatgctgcctttattatatattaagtttcaacttattatatattaagtttccgcttacatcttgtcagtttctggactccatattttgtttgatatatttatctattctgcattaagactgcatttttaattataatagctttataatatctcaatgttgtataggaaaaaaacttcaattattaattagttatactaagccaatgtctaagtattgcttagtggtttgtgggcaaccatcttacacagtacctagtaacagagtagacaagtgtttattgaatggatggatgaatggatgtgtggaagaggctttcagaaacaattcccttcatagactaaggccaatgttacttttgcttagctctttagtttgaaataatttaaaatgtacagaaaagttacaagaataatacatggaacttgcacacaccctttacccagattcacaaatgtttaacattttgcaattttgtttttcattttcttttctttatatacacacttctgttacttattttctatttgaaaattagttgcagacatcacatccctttacctctcaatactttagtacacatttcctgtgaataaagatatcttttacataacagacacttcaaattgataaagcacatttccataatttacaactggtattccagttgtatcaaccaatgctgtcatttatagcattttcttctttgaagtacagggatctagtacaagtaactacttgtcctgcttctttcatttccttgaatctggaccttcatcagatggtaactttaagcacccaaaggtttttttctggtttctcctctgtgtagtttaagaccatgcaaacatcttgctactcatcaaaatgccccccatataacatccaaattaatctttatcatgatggtttatgactgtctcctcacattgggattggggcccaactgattattaacaatctacttttttggaagatataatatctcttcctgggaataagataatgggcataacatataataattcctaattgtatcatgacaatcacaatccaaaatactaaatctgtgatgtgtctaaatctcttttccccattgtttttgcaggcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggttagttattatatttttcttgtaccaacagctgtgaatgcttcactagccattcgtatgctcttttgcccactagctcacatgctgtcatttatagcattttcttccttgaggtacagggatctagtttctcctctgagtagttattattttcacccttgcaactaataaacagtttgaaggatcacgtagtagttctatttttagttttttgaggaacctccttactcttttccacagtatttgtacttatttacactcccaccaacagtgtacaagcattccccttttgccacatcctcaccagcattttttaattattttgtctttttgataaaagccatttaactggagtgaaatatctcattgtgcttttggtttgcatttctctggtaattagtgatgttgagcagtttttcatatacttgttggccatttgtatgtcttctttttttttttttttttttttttttcagacggagtctcgctctgtagcccaggctggagtgcggtggcacgatctcggctcactgcaagctccgccacccgggttcacgccattctcctgcctcagcctcccgagtagctgggactacaggtgcccgccaccacacccagctaattttttgtatttttagtagagacagggtttcaccgtgttagccaggatggtctcgatttcctgacctcgtgatccacccgcctcggcctcccaaagtgctgggattacaggcgtgagccaccgtgcccagcctgaatgtcttcttttgagaaatgtctattcagatctttgtccatttttaatagggttctttgttttttttgctattgactagagtttcttatatattctggttattaatgccctctcagttgtatagtttgcaaatatttcatcccatcctataaattgtctcttcactttgttaattgtttcctttgctgtccagaagctttatggcttgatataatcccatttgtctacttttgctttagtcccctgtgcttttgaggtcttacctgcaaaatctttcccagaccaatgtcctggcgcattcccccaatgttttcttccagtagtttcatactttcaggttgtatattttagtctctaatccattttgatttgatttttgtatatagtgagagataggggtatagtttcattcttctgcatgtggatatccagttttcccacaccatttattgaagagactattctttcaccagtgcgtgttcttggcactttgtcaaaggtgagttggctataaatgtgtggatttatttctgggttttctgtcgtgttccactggcatatatttctggttttatgccagtaccgtgctgtttttgttactacagctttgtagtatagtttcaagtcaagtagtgtcatgcctccagctttgttcattttgctccagattatttagctgtttggagtcttttgtggttccacacaaattttaagattcttttttctatttctgtgaaaaacttcactggcatttggataggtattacattaaatctggtagcattgatattttaacaatattagtttttccagcccattaaaatgggatagataccttttcagttttttgtgtgttcttcaattccctttatcagtattttagttttcattatagagatatctcagctctttggtttaatttattccaatatatttatttttattatagctattgtaaatgatttttaaaaaatttctttttaggttgttagctcttggtatatagaaatgctactgatttttgcatgttggttttgtatcctgcaactttactgaatttgtttatcagttctaatagttttttgatggagtctttagttttttgtgaaatataagattatgtcatctataaacaaggagaatttgacttcttcctttccaatttgggtaccctttatttctttctcttgcttacttgttctggcttggacttccaggactacattttatagaattggtgaaagtgggcatccttatcttgtttcagatcttaaaggaaaggcttttggttttccacatttggtatgatattagccgtagtttgtcatatatggcatttattgttttgaggtaagctttctatacccagtttgtttagagttttctcatgaagggatgttgaatttaatctttttggcatcaattgaaatgatcatttgtttttgtccttcattctgttgatatgatgtatcacattgattcatttccatatgttgaaccatccttgcatccctgggatgaatcccccttgatcatgatgaatgatcttttactgtgttgttgaatttggtttgctagtagttcgttgaggatttttgcatcaatgttcatcagagatattggcctgtagtttctttttgtgtatgtgtgtgtctttgtctggtttggtttcagggtaatactggccttgtggaatcagtttggaagtatttttcccccttgatttttgggatagtttgtgaagagctggtattagttctttttttttattattatacattaagttttagggtacatgtgcacaatgtgcaggttagttacatatgtatacatgtgccatgctggtgtgctgtacccattaactcgtcatttagcattaggtatatcgcctaatgctatccctctccccttcccccaccccacaacagtccccagagtgtgatgttccccttcctgtgtccatgtgttctcattgttcaattcccacctatgagtgagaatatgcagtgtttggttttttgttcttgcgatcgtttactgagaatgatgatttccaatttcatccatgtccctacaaaggacatgaactcatcatttttatggcggcatagtattccatggtgtatatgtgccacattttcttactccagtctatcattgttggacatttgggttggttccaagtctttgctattgtgaatactgccgctataaacatacgtgtgcatgtgtctctatagcagcatgatttatagtcctttgggtatatacccagtaatgggatggctgggtcaaatggtatttctagttctagatccctgaggaatcgccacactgacttccacaatggttgaactagtttacagtcccaccaacattgtaaaagtgttcctatttctccacatcctctccagcacctgttgtttcctgactttttaatgatcgccattctaactggtgtgagatggtatctcactgtggttttgatttgcatttctctgatggccagtgatggtgagcattttttcatgtgttttttggctgcataaatgtcttcttttgtgaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagttcccatttgtcaattttggcttttgttgccattgcttttggtgttttagacatgaagtccttgcacatgcctatgtcctgaatggtattgcctaggttttcttctagggtttttatggttttaggtctaacgtttaagtctttaatccatcttgaattaattttagtataaggtgtaaggaagggttccagtttcagctttctacatatggctagccagttttcccagcaccatttattaaatagggaatcctttccccactgcttatttttctcaggcttgtcaaagatcaggtagttgtagatgcgtggcgttatttctgagggctctgttctgttccattggtctatatctctgttttggtaccagtaccatgctgttttggttactgtagccttgtagcatagtttgaagtcagggagcgtgatgcctccagctttgttcattaggcttaggattgacttggcgatgcgggctcttttttggtttcatatgaactttaaagtagttttttccaattctgtgaagaaagtcattggtagcttgatggggatggcattgaatctataaattacattgggcagtatggccattttcatgatattgattcttcctacccatgagcatggaatagtcttccatttgtttgtatcctcttttatttccttgagcagtggtttgtagttctccttgaagaggtccttcacatccgttgtaagttgtattcctaggtattttattctctttgaagcaattgtgaatgggagttcgcttatgatttggctctctgtttgcctgttattggtgtataagaatgcttgtgatttttgtacattgattttgtatcctgaggctttgctgaagttgcttatcagcttaaggagattttgggctgagacaatggggttttctagatatacaatcctgacatctgcaaacagggacaatttgacttcctcttttcctaattgaatacactttatttccttctcctgcctaattgccctggccagaacttccaacactatgttgaataggaaaggtgagagaaggcatccctgtcttgtgccagttttcaaagggaatgcttccagtttttgcccattcagtatgatattggctgtgggtttgccatagatagctcttattattttgagatacgtcccatcaataccaaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttttgtctctgcccggctttggtatcaggatgatgctggcctcataaaatgagttcaggaggattccctctttttctattgattggaatagtttcagaaggaatggtaccaattcctccttctacctctggtagaatttggctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctcttttcttctttattagtcttgctagcggtctatcaattctgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccatctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttgttttacatttgctgaggagagctttacttccaactatgtggtcaattttggaataggtgtggtgtggtgctgaaaaaaatgtatattctgttgatttggggtggagagttctgtggatgtctattaggtccgcttggtgcagagctgagttcaattcctgagtatccttgttaactttctgtctcgttgatctgtctaatgttgacagtggggtgttaaagtctcccattattattgtgtgggagtctaagtctctttgtaggtcactcaggacttgctttatgaaactgggtgctcctgtattgggtgcatatatatttaggatagttagctcttcttgttgaattgatccctttaccattatgtaatggccttctttgtctcttttgatctttgttggtttaaagtctgttctatcagagactaggattgcaacccctgcctttttttgttttccacttgcttggtagatcttcctccatccttttattttgaggctatgtgtgtttctgcacgtgagatgggtttcctgaatacagcacactgatgggtcttgactctttatccaatttgccagtctgtgtcttttaattggagcatttagtccatttacatttaaagttaatattgttatgtgtgaatttgatcttgtcattttgatgttagctggttattttgctcgttagttgattcagtttcttcctagcattgatggtctttacaatttggcatgattttgcagtggctggtactggttgctcctttccatgtttagtgcttccttcagaagctctcttaggtcaggcctggtggtgacaaaatctctcagcatttgcttgtctgtaaaggattttatttctccttcacttatgaagcttagtttggctggatatgaaattctgggttgaaaattcttttctttaagaatgttgaatgttggcccccactctcttctggcttgtagagtttctgccgaaagatcagctgttagtctgatgggcttccctttgtgggtaacccgacctttctgtctggctgtccttaacattttttccttcatttcaactttggtgaatctgacaattatatgtcttggagttgctcttctcaaggagtatctttgtggcattctctgtatttcctgaatttgaatgttggcctgccttgctagatttggcaagttctcttggataataccctgcagagtgttttccaacttggttccattctccccatcactttcaggtacaccaatcagttgtagatttggtcttttcacatagtcccgtatttcttggaggcttcgtttgtttctttttattcttttttctctaaacttatcttcacacttcattttattcatttcatcttccattgctgataccctttcttccagttgatcgcattggttactgaggcttgtgcattcatcacatagttctcgtgccgtggttttcagctccatcaggtcctttaaccacttctctgcattggttattctagttgtccattcgtctaattttttttcaaagtttataacttctttgccattggttcgaacttcttcctttagctcggagtagtttgatcttctgaagccttcctctctcaactcatcaaagtcattctccatccagctttgttccattgctggtgaggagctgcattcctttggaggaggggaggtgctctgattcttagagtttttggtttttctgctctgttttttccccatctttgtggttttatctacctttggtctttgatgatggtgacgtacagatgggttttcggtgtggatgtcctttctgtttgttagttttccttctaacagtcaggaccctcagctgcaggtctgttggagtttgctggaggtccactccagaccctgtttgcctgggtatcagcagcagaggctgcagaacagcagatattggtgaactgcaaatgctgctgcctgatcattcctctggaagttttgtctcagaggagtagctggccatgtgaggtgtcagtctgcccctactggggggtgcctcccagttaggctactcaggattcagggacccacttgaggaggcagtctgcccgttctcagatctcaagctgcgtgctgggagaaccactactctcttcaaagctgtcagacagggacatttaagtctgcagaggttattgctgtcttttgtttgtctgtgccctgcccgcagaggtggagcctacagaggcaggcaggcctccttgagctgtggggggctccacccagttcgagcttcccggccgctttgtttacctactcaagcctgagcaatggcgggcacccatcccccagccttgctgccaccttgcagtttgatctcagactgctgtgctagcaatgagcaaggctccatgggcgtaggaccctctgagccaggtgcaggatataatctcctggtgtgccgtttgttaagcccgttggaagagcgcagtattagggtgggagtgacccgattttccaggtgccatctgtcacccctttctttgactaggaaagggaattccctgaccccttgtgcttcctgggtgaggcgatgcctcgccctgcttcggctcacgcacagtgcactgcacccactgtcctgcacccactgtccggcactccccagtaagatgaacccggtacctcagttggaaatgcagaaatcacccgtcttctgcatcacttatgctgggagctgtagactggagctgttcctattcggccatcttggctcccaatgcaaagaccttcaaacaacgtgacttcattttctcactcctaccttttgtgctcttgtcatttatttgaattctacatatattttaaaccccataagacattattattgttttatataatcaatatcatttatatatatatatatatttacacctttcatttctttcattcttttctgcatttcttgcttccatctatgatcattttctttttgtctgaagaaacttctttggaacttccttcagtgtgtgttggctagtaaaaagttctctgtcagtttttggtcagaatgggtctttattttgcctagatacaagtccttggttggatttacatattgtgaatgttttctcccagtctgtggtttgtcttttcactcctttaagggtgcattatggttaatagaagttcttacatttaattaattcttatttttcagttttttatggttaatgccttttgtattctgtttcagaaatttttgcctatcctaagaacatgatgccatccttctatattttctttctacatattttaaatattttcttctagaagtctgattgctgtgttgttcacaattaagtttatgattcatttttaattaattttgatggagtgatgcagataaaagttcatttttccatatggatatttaattgctctagcaccaattgttggaaaaaaataatttcctcactgaattgcactgttgtctttgccatgaatctgatgactgtatcactgtagctttgtttctgtactctatttcaggggtaggttatgatccacaagccaaatttgcagcttgtttttatatggcattgagctaagaatttttttacatttttaaagaattgtcacacaaaacaaaaaaaaagcaaaaaaacaaataaggatatgtatcatggaccatatgtgtctacaaacctaaaatatttactatgttgctttttacagaaaaagtttgccaacccctgatctcttatattccattgacttattggtctatctttgtaccagtaacatactatcttatagtaagttttaatatttgttagtataattcctccaactttgctctctttgatttttatataaattttagaatcatcttgtcaattttatcaataaaaatatcttctgaggttttgatagggattacattgattctgcagatcaatttgggggagcatacctcttgacaatattgagtattcctgtccatgagcatggtttagttatttatttacatcttttaaattttctcttggcaatgtttttgtaaaattttagtgtacaggtcttgcacatttttgtaaagtgtattctttggtatttaatgctattataatattttttatggtatcagtttttgtcaattgtgtttttctagaaatatgtccctttcatctaagttgtttaatttacttgaagtaagttatttgtaatgttcttttatcatccttataatgtctgtactgatgtctccgttttcatacctgatattgttatttatattttatctattttaagtttatcgcctgcacccactaactcgtcatctagcattaggtatatctcccaatgatatccctcgcccctccccctagtgcacatgtaccctaaaacttaaagtataataaaaaaaaaaagtttgtcgcctttgttataggttcatcaaatttactaatcctaccataggatcaaatttttgctttgttcatcaggtcatggaattaaaaaaatttttttgttttgtttattttctatgttgaatttttatttttattttgctttgcatttcatttatttctggtcttttgttattattccaatactttctctggattcagttttctttttcttcttgacttcttgagattaaaacttggttcattgattttcaacatttcttactttttaaaagttcatacaaagcataaatttccctttatatactgctttaaccccatatcacaaattttgatgagtcatatttttattatcattgagtttaaaatattttataaattttacgttatttcttgttttattcatagttattttacagtgttttacttaatttcccaatatatggcgattttctggctctctctctgttgctgatttatttgttttactgtgatcacataacatactctatattatttcaatcatttgaaatttgttgagacttgctatatgcccagtgaataatttaatttgattaatggcccactgcatttgaaacaaatatgtctttgctgttattgggtagagtgtcatatatttgcctattatgtcaagttgctttatcatgtttttaaaatccttataaacttcctgatattttatctgtttcttacagacatggaggaaactgtgacatctctgtgattgttgagtttgttattttgatttttgtatttgttagtaagaatgtttcaaaataaatgaggcaatataaaatcaggtgcttacaactttaaggttgtattcttattaaatcaattctttcatctttgtgaaatgtcctttttgtctgaagtagtacttgttgccttaaacgtctgcattgtctaaaatttatacacctgcactatcatatttattttgcttaatgtttgtgtggtatatatttcccattcttttcttttcaacctatctctatccttatatttacagtgtgtcttttttaacattttctgtagtgcaagtctgttggttaattaattttgtcagtttttgcttctctgaaaagtctttatttctgtttttgaattatatcttcactgtgtatagaattctgggtttgtggttgttgtttttgttttattacattttgttttattggtttttccctcagcactttaaaaatgccgctccattgtttctacttgcatagtttttcacaataagtttgttgtaattcccatttgcattcaactgtacataatgtatctttttaaaaaaatctggatggcttcaagctctttactttgatttttgtgtgtgtgtgtgtgtgtgtgtgtgtgtgtgtgtgtgtgtgttactttggcattctctaggcttattcaatctgtaatttggtatcattaattttgaaaaatatttatcatctgtgtcttcaaatattgcttctaattctttctcttcttctggtattgcatttacatatattatactgttcaattttgtcacacagctcttgaatatgctgttctagtttgttttctaactatttttccttctagttgttcagttttgttgacatttattgacctatttttacttcagtaattgtttcctgggttgttgagttaattgatgaactcatagatgacatacaatttatctttttattcttgtgtcacttgtgcttttgatgtcacatctaggaaggctttgtctagcccaaggccacatttacttccatattttcttctaagagtttgatagttgtagctgttacatatatgtctatgatctagtttgaataaatttttgtgtatggtgtgaagaagaggtctaacctcttttttattttttgcatgtaaacatccagttgtcccggcaccatttgttgaaaatatgattcttttcccattaagtcatcttgacacccttgttgaaaatcaattgaccataaatgtgagagtttatttctgaactctccattctgttccattgacccatacgtcttctataaattcttatagctaattctacattagactttggtttttcagatgtggtcatctcattagattatggtgatatgtttggttacaagttttatcttctccttggcaacattttttttattactgctcttcttttattcgtttttgttgttcctttctctttttgtgagacagggtctcactctgttgcccagggtggagtaagtggtgtgatcatggctcactgcagcctcaacctcctgggctcaagcaatcctcccacctcagcctcccaagtagtgggactacaggcatgcaccatcatgccaggctaacttttttattttttgtagagacagggtcttgctttgttgcccaggctggtcttgaactccaagctcaagcaatcctccaacctcagcttcccaaagtgctgggattaccagtatgagccactgcacctggccttgttgttcctttcttccttttatcttgtagtatcttgatcctttttgcttattatttatcattgaggtgagtttgttctaaataaacttttcgcagaaagtttatgtagatatattaatatcaatgaggcattaggagtgagttttagattagcaggaattctcttatgaaaggtattgattgtatgtgtgagttttcagcctttacttctctccagcccatcaagatcaaagctgcagagttgtttacatttcagaatttctttcctcccctccccaccttgcaaaacagacttacagtgcaaaaatgacttgtcaatgtgattctttcttctggtcccatctttcctaccttttgagacttgtgttgaaaggagtccagtaaaaccaccgatgctagcttgtataccctgatcccattgttataatgaatgactgactgtttttcatatcaaagtataatacttgcaccttgatagaagaaagaaacaaggccaggcacagtggttcatgcctgtaatcccagcactttgggaggctgaagtaggaggaataattagactttgatattaaaaatggggaagatatggcggtataagatatgaggaagtatgtcttcttggacttttctgaaatctgccagccatgagcatccactctttttatcttttgatacctgttttatattaactatacttctattttgtggtttcatggcttcagatatcttccagcttaattgtactctgtctttaattatttgcagcaatttctgaaaggagcaagaagaaaggccagccctttcttcactaccttaaaaactggtcatcttttgaaaccccatgaaaggcacagtgggtgaccatctacatcaggagtgggcaaactatggcccttgggtagtctggtctctgtccgtttttgtaaggttttattggaacccatacacacacaaactgatcatctcttgttatgtgttaagttttcttataattattcttttctatttcatccagctgaattaccatttcaccttgtgtatgccctttccagtcttaaattatagaagctatgtctttgtggttttaaattatggaagctgtgccttcttgtgttttagtatggcaagatatttgttcttacttttcctctagaatctgcagtggattactttcagaagtaggtattgcctctaagtttcctgacttctgtttccttctccctgttctgtagtatatttatagattgcatgttttctcgtccttaaacaaggtacaaatatgttctgatcaaggtttgctagccgagaggataagtggcttgctcttagcctaactctctgtctacttaatggatgtcgaattcccttctcaactcaacagctagtaactagttccaagatcggataatagcttacagaattaattagttcagtgaaagccctggtttgatcacagaggcaggagactgatctatatatttgtagtgctgactagaccccaacttggccagatagcttatacctatgtcagaagttggaggaggagattgacagctgaggtgtctccaagggaattacaattattttcattttctttgtgtctgtaattatgtctcttttcttacttcaaattttgtatatgtgaaatttcttaatttttatttggttatttattttattgactttttcatcaaacaaccaactctaagttcttggattgaaatttatgaattaattataatgttttaaatttaccattagtcacacatacaatacaaaaagatattttcattacaaaattttaacccaagccattaaaactaaactccagcttggtcaccattcctaataccaggcccctctcagaggggagggtaaataaaagtccattttggtaactagtttgacgagaatctctaattgtttccctgtttttcttataatgtctgcctttgaattatcctctttttttcaagagttccatcatataatgtattcctttttgcttacagattgacctcctagaggcatgcatccccctgctccagtctgagctggttctctctaggcctgaggctcagttatcaacttgggacttttatttaccctccctcaggataggtacctggttcttggataccaggtcttactcttgtttgagatactcctttattttggtggcaaacattccataatcacttcctgataatggtgacatttgaggtagattttctgagtctttatatgttagaatatgtttttattctcctttgccacttgattgataatttggctgcacatagaatgtaagcattcacagggcttttgggagcagcttcccttgagaagaaggtggatgcagttaagatcttccctgaaaagactgtgtgaaatgacaaggctattgaggtacccaacgggtagcttggtaaaggtgtatcttgtctcttatgtttatgcatctactttaccaccatgtaattagcctattataacttgttgcattccttcactcagctaatcttgttcatggtagaaattaatattgctagtaccatggtagaattttatattagctggatcctagacctaaatgctccttccttgtgcttacatattctgcaagtgggtgacagtggatgctaggtattgtgttatgtgatttcaatgtattatatgatggggtagatactattagcctcatttgaaaattagaaacctattgttcagaaagtttaagtgactttctcaaagtcacacagctggtaaatggtagaactgggatttgaatccaggcaatctgatggatttaagaggaacctgtgccactatgtgatatagcaataacatctagccaatataaatactttcctgaattaaatcactgtcatattcagagagttctgtgtcactattaagaccctccattattgtgtatattaattacatttccctattttaatcccaatatctattcatttttatcacagtcctttcttatggtcacaaacaggcatagtacaacagcagcaatgcaaaaaccacttttatattacatgttccagggatttaacccaatgacctgtgatataatgatactgactagtattttttcatttatctgggaatgggagagaacctctaacagaacgttttagaatctgtgttatgagtaaccagagtcttattcttcctcatctccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacaggtatgaatgcattggttattcctttgctctgctcttgtgacatttgactttaccagatgatgacaccaacaatgagagttagaggatgaaaaatcaaggtgtcttgaaactcttactctggtgagatagagagaagagaggtttacaagagggtagaggaatcagggacaagaaggagcaatggggagcaggaagaaagtcaacctcacctatcaaccttatgagctgcaggggaaatcttagtctcatcagagaactttaagcaaggcagaaggaagaagcaagttcgtgttaaagaggttaaggacttggggaggattggttttcatgatactggggatccagagggcaaagtaggatgattttatttttaggtgagtagagggaggttgagcagtcaagtagtacagagaaatgtggaatataaacataaggagagtcagtcagtcacaaatatttatggaacacctactacatgccagacacttttgtacacattggagtgcagcacagcaggagcttatattctattggaaagagcaagagacaagttagtacaaaactaaataaggcaatctcaattgtgttgttcagaagatagaatagaataatatggtagagagaataatatgatagagtaatacggtagagtgttacattagctgtggtggtcatagaaatcatctttgaggagttgagacctaaatgatgataacaggccagctgatggagctctgagagaagatgtttccagacagagggaagagaaaatgcaaaggccctgagaatggaaaaagtttaccatgtttgaggaacaagaagggacaagcatgacttgtcactttcccaccttgctttctagctcaagtaagcccttattgctgcattgcaaccatagactatttccctagtccactgactttctcattctcctggacctctatcttagattttctgtgttttccttaaatctcgagcaccttttttccattctccaatgcccattttcactcttagctgatgctgtgcaatgaacctccacagactcccaacatcacatttactggcatttgtacccatatactctgcctgcacacttattacaataaatagagtgtctgtgctcctaaggccaacctctccagttttgtacttgattcccatctcttctcccttcataaaaaatgttgctccagcaatttctccttttctcccttacatcatcaatttatctctccactagattaatctcatcaacatcaatcatgctattatttcctcccctatctttacagaaaccgtcttaaaataattgtccctgcttgcagcctttgcatcttttcctgccattctctcctctttaacccactccaaagaagcttttatctctattatttcataagaactacattttcaaggtcattattgatctttacattactgattactagccctcatcttatttgaattctcagtagtatttgagaggtgattactccatcgttgatacaggttctcacttggtttctctaacaccacttttcttcacttttctactaaacttactgccaatctttgtcaactttgcgagtccttcttcatccccctaatctttaaaggttagagtgctccagggattagttctccaacttcttctttattctatttatactcactctgtgacgacattgtttagcctcatgattttaagtactatctatctgcagataattccagttgaatatctggagatattctcagatctctctcctgaagtcaaaatttacatatcaactccctaccttaacatgcacacaattagactcttaattcctgccccttcccaaaacctgctgattgctcagccttctccatggcaatcaaaaaccattcctggccgggcatggtggctcactcctgtaaccccagcacttggggaagctgaggcaggtggattggttgagccccagagttcaagatcagcctgggcaacatggcaaaacctcatctctattaaaaatacaaaaattagccaggcgtggtggtgcacacctgcagtcccagctactcaggaggctgaggcacgagaatcgcttgaactggggagacggaggttgcagtgagctgagatggcctcactgcactccagcctgggcaacagagtcagacttgatctcaaaaaaataaataagtaaaaccattccctatttcagttattcagtcacagatcttgaagttttccaactctttttttcttacattaacatctaatctgtaaaggatcctgtattagtccattttcacactgctaataaagacatacctgagactgggcaatttacaaaagaaagaagtttaatggactcacagttccacatggctggggaggcctcacaatcatggcagaaggcagggaggagcaagttatatctcacatggatggcacaggcaaagagagagagcttgtgcagggaaactcctctttttaaaaccatcagatcttgtgagacttattcactatcatgagaacagcaagggaaggacctactgccatgattcagttacctcctatcaggtccctcccacagaacatgggaattcaagatgagatttgggtagggacacagccaaaccatatcattccaccccatcccctcccaaatctcgtgtcctcacatttcaaaaccaatcatgccttcccaacagtcccccaaagtcataacacatttcagcattaactcaaaagtccacagtccaatgtctcatctaagacaaggcaagtcccttccacctatgagcatgtaaagtcaaaagcaagttagttacttcctagatacaatggggtataggcattgggtaaatacagccattccaaatgggagaaattggccaaaacaaagggcctacaggccccatgcaagtctgaaattctacggggcagtcaaatcttaaatctctaaagtgatctcctttgactccatgtcttgcatctgagtcatgctgatgcaagaggtgggtgcccatggtcttgggcagctccacccctgtggctttgcagggtacagcctcccttgtgtctgccttcatgggctggcattttctgtagcttttccagatgctggtgcaagtttctgatggatctaccattccggggtctggaggacggtggccctcttctcacagctccactaggtggtaccccagtagggactctgtgtgggtgccctgagcccacatttcccttctgcactgccctagcagagtttctacatgaaggcccacccccgcagcaaacttctgcctgggcatccaggcacttccattaatttctaaacaacaaagcattcaagaggcgacttgggtgctattaagggcattcagtttcataagggaagcagagcataaaagtttggaaaatttgcagcctgataatgttagagaaaagcaaatcccattttctgaggagaaattcaagcaggctgcagaaatttgcataagtaatgaggagccgaatgttaatccccaagacaatggggaaaatgtctccagggcatgtcagaggtcttcacaccagcccctcccatcaccggcccagaggcctaagaggaaaaagttgtttcatgggctgggcccaggatccccatgctgtgtgcagcctagggagtcggtgccttgtgtcccagccgctacagccatggctgaaaggggtcaatgtagagctcaggctgtggcttcatagggtacaagtcccaagccttggcagcttccacatgatgttgagcctgcgagtgcacagaagtcaagaactggggtttgggaacttccgcctagatttcagaagatgtatgaaaacacctggatgcctaggcagaagtttgctgcgggggtgggccctcatggagaacctctgctagggcagtgcagaagggaaatgtgggctcagagcacacacacagagtccctgctggggtaccacctagtggagctgtgagaagaggaccaccgtcctccaggccccagaatggtagataccctaaatcatctctttcaaattcgaagttccacaaatctctaggacaggagcaaaatgccaccagtatctttgctaaaacataacaagagttacctttgctccagttcccaacaagttcctcatctctatctgagaccacctcagcctggatttcattgtccatatcattatcagccttttggtcaaagccattcaacaagtctctagagagttccaaactttccacattttcctgtcgtcttctgagccctccaaactgttccaacctctgcctgttacccagttccaaagtcgcttccacatttttgggtatcttttcagcagcaccccactctactggtaccaacttactgtattagtctgttctcacactgctgataaagatatacctgagactgggaaatttacaaaggaaagaggttttatggacttactgttccacatggctggggaggcctcaaaatcatggcagaaggcaaggaggagcaagtcttgtcttacatggatggcagcaggcaaagaaagaaagcttgtgcaggaaaactcttttttttcttttcttctttttagacagagtcttgctctgtcacgcaggctggagtcagtggcgtgatcttggctcactgcaacctccacctcccgggttcaagtgattctcctgcctcagccttccaagtagctggtactacaggcatgtgccaccacatgagatgagattttggtagggacacagccaaaccatatcattccccctgtcccctcccaaatctcatgtcctcacatttcaaaaccaatcatgccttcccaacagtcccccaaagtcataactcatttcagcattaactcaaaagtccacagtatttttagtagagatggggtttcaccatattggccagactggtctctaactcctgaccttatgatccgcccgccttggcctcccaaagcactgggattacaggtgtgagccaccatgcccagccaaaaactcttctttttaaaaccatcagttctcatgagacttattcactatcacaagaacagcataggaaagatctgcccccatgattcaattacctcccaccaggtccctcccacaacacatgggaattcacgatgagatttgggtggggatcctcttggctatcatttcaaaaaatagtcagggttgattatggacttagtattgaataagatgaaaatgtactgaaatggaacgatgaagataattgaccagggaaagcaggttacaagccaagagaggatacagtgtcacttcagatgctataaaagtgatgtttttattttttgaatgttatttggctatattttcaaattatctgcactgcatatgcactgcttctgtaataataaaagggtattaaaataataaaatcaagtctataaatcacacacacacaccccagcctcttctctacacctcagtgactaccaaccacatctaaattatcatcatttctcatctgaattattgcaagaagccattgcaataattcagatgagagttgatacaaagccttcctgtttccaaccttaccctcatatagtcttttcccaacattgcatctaaagtaatttttcaaattgcaattctgatcactgttctctgcttcagatcctccagtggattttcatctcactcagtaaattccaaagccttcaccatggccttcaagaccctacgaaatttgaccctctgcaacctctctgccttcatctgttaccattgtctcctgttaatcctgcctcagccacactgacctccttgttcttctcaaatggactagatgtgtgcctatctctagaccattacagtttctgttctctctacttaaaattatgtccctgatactctaatgcaagttctcttacttccttcaggacgctgctcaaatttcattttatcagtgaggctttccctgaacactgtatgtaaatattgctcccaccattttttttcaatgcacttaacagtgcctgaaatattatatatttatttctttattgtctatcttctctgactataagttaagctcattaagaacacaaactttggaggtattgttcaatgttgtgtccccagaactttgaacagtgcctggcacgtggcagatgttcaaataaatgtatgttgaatgaattagaaaatgataaatgtagggagacaaaagcaggtctcccatttatatccaaactctaggactctaggaaagactgattatatggaatcgtgtcacacagcatccatgggcaagagtggaggcagagataccagttaagatgctattgcagtcatacagataaaagaagacagttatttagaccagtgtggtggtgacagaaatggaaagaaatggaaggatgttgggtataattaaagataagcatataagactggctgttaattgagtatgggaagaatgaggagagaggatgtaaagaacatttctttttgtttgtttgttttgttttgtttttgtttctttttattatactttaagttctagggtacgtgtgcacaacctgcaggtttgttacatatgtatacatgtgccatgttggtgtgctgcgcccattaactcatcatttacattaggtatatctcctaatgctatccctccctcttccccccaccccccaacaggccccggtgtgtgatgttcccctacctgtgtccaagtgttctcattgttcaattcccacctatgagtgagaacatacagtgtttggttttttgtccttgcgatagtttgctgagaatgatggtttccagcttcatccatgtccctacaaaggacatgaactcatccttttttagggctgcatagtattccatggtgtatatgtgccacattttcttaatccagtctatcattgatggacatttgggttggttccaagtctttgctattgtgaatagtgccgcaataaatatacgtgtgcatgtgtctttatagcagcatgatttatagtcctttgggtatatacccagtaatgggatggctgggtcaaatggcatttctagttctagatccctgaggaattgccacactgacttccacaatggttgaactagtttacagtcccaccaacagtgtaaaagtgttcctatttctccacatcctctccagcacgtgttgtttcctgactttttaatgatcgccattctaactggtgtgagatggtatctcactgtggttttgatttgcatttctctgatggccagtgatgatgagcatattttcatgtgtcttttggctgcataaatgtcttcttttgagaagtgtctgttcatatcctttgtataagattattagtggatttctcagaagaaatattgtagaccagaagggagtgaaaatatagatttaaaatcctgaaaggaaataaaaactagcaatgaaaaatactatatccagtaattttatctttcagaaatgaaggggtgataaagattttctcagaaagacaaaagctagatctgctttataagaaatgctagtaggagttcttcaagctgaagaaagaggatgcttattagtaatatgaaaacatatgaaaggataaaactcactagtaaaaataagtacattgtcaaatccaaaacactctagtagtgtaatggcagtgggtaaattaattatatctttagtataaaagataaaagacaaagaaagctattttaaaaactaaagctataataatgtgttaaggaatgcaaattattaaaatatgtaaactgtcacatcaaaaacataaaataggctgggcacagtggctcatggctgtaatcccaacactttgtgggggccaaggtgggaggatcacttgagcccaggcatttgagactaacttgggcaggatagtgagatctcatctctataaaaaatttaaaaattagtaaagcatggtggtgcatgcctgtagtcccagctactcaggaggtggaggtgggaggactgcttgagcctgggggggtcaaggctacagtaagcaatgatcacaccactacactccagcctgggcaacagagcaagaccctgtctcaaaaaaaataataatatgtaggaggaagggaataaaagtgtagagtttgtggatgcaataaaaattaagttgttatcagtttaaaatagcctgctaattttgtgtaagcctcatagtaaccacagagcaaaagcctatagtagatacacaaaacattttaaaaaggtccaaagcataccactacagaaagccatcaaactataaaggaagaatgcaacagaagaagaaaggatcaaaggatctaaaaaaaaaaaaagaaagaaagcaattaacaaaatgacacaagtatgaccaaagtccactgcttctttattactgatatagaatatctttcagatcttaagggactgattaattacttgggagagaaagtttgtgttgagaagatttgcttgtgttgcaatgagaaggggaagttctactcaacagaagctgtacaggcacatatgacaaaagctggtgtaagctttttacagatggtgatgctgctttggaatttgcagacttgtatgagtttaggagtagctacccagatcacaaggaaggggaggaccctaatgaggctgaggagtcgcccttaggaaaggacttagaatatgatgatgaaagcatggaactgattctgccttctgatgccagagtgggtcatcactccttgatgagatactacaaacagtgatttggcttgtcaagagctgtggtagttgctaaatattgtgaggccatgggccgagtgcttcagtaatagagagccctgggatagactggcaacacaggagcagctgttacatgaaagtgagacatgcattatatccaaaggatgaagtcaaaatggatgctgaagacagaaatgaagaacaatgccaccaagcagatgcactttagggtccaagtgagattctgagagtctgccaggattgagtgattgtctgctgcccaagtttcctccttgccctgaggaccagggaaagccagattgtatgatggacacttttgctgctacttcacttgctctaacataataataaaaatgaaaatctaaaaaatattttattgaagaatgaaggtgaaagaaatacattttcagacaagcataaacagagaaacttcaccattagcaaaagtccactaaaatattctaatgttatacttgagacaataaaaaagtgatacagaatggaaggcatgagagacaagatgggataaagagcaaacaaagttaaatatgtggataaatagagataagtatcataaaacatggtcaaatgttttatgagcgttaagatatatagaattgctttattcacagttggtttgctgtcataacacaagtatcatgaaaatcactgctaaatctaagccaaaattgggaaaggaaaaggttcatgtcactatcatcaacgttggacatgtagactcaggaaagttcaacactactggtcatctgatctataaatgtgatgtgatcaacaaaggaaccattgaaaaatttgagaaagaacctgctgagatgggaaagggctcatttgagtatgcttgggtcttggataactataaactgaacatgaatggaatatcaccattgatatctcctaaagaaacctgaggccaaaaatatcctgtgaccatcattgatgccccagcacacaggggctttattaaaaaaaaaaaaaaaaaaaaaaacatgattagagtgatatcaccaaaatggtggatagaagcaatctggcttcactctcctccagaaaaaccaaaaacaactattcagtgtctagcttatcaccaggaatatcccataactcaaaacagaggctgtgaggatctgagtggccacatagaagagaaaaactgcaagcagaagataacaaaaatgggcctgtttaactgcagcatccccttcccaagctgccaggcaccatgcagaaaagttcccccagactgacagtatgtacatcagaaaaagtgacatctagatgaagagccagctttcccaccatcttgggttcctttgcagaaaaatcattcctgcctcaatccgtgggaagcagcctgattgcctctagggtaaaaaaatcctgagggcagctagagacaaaggatggaggcggggctagcaaccccagcatgcaaaacacattggctgctcttcatctaagccaaagaagacaccaaatgagagagaatgttcagcccgtggttcctctggacacaaaatcctaaccagatgtctcacccaaccaggatatccagtttgggacctcccccaaatcgggaataggcagtaatccaagccgttgcaagagctgcagcaaatctgggcttacagcaccatctagtgccaaaaaagaggcagtaatctcagagtaaggaagctctaattcatacataacctttagacaggcatactcctgaaaaaccaaactaagccagacacaaagactggaataaataacttagcattcatacaaagacatagatatatgtgcataaaaaacaagagcaaatagggagctatgacctctccaaatggaaacagcatggagccagtgaccaaccctaatgagatggcaaattgtagctctcaaatcaataattcaaaataaaagttctgaggaaactcaaagaacacaaaaaagcaactgagaaatttatgagataaatttaacagagaaatcaaaataataatttaaaaaaccagaaatgctggagctgagaaatacaactgaacggaaaaaaaaaatgcactggaaagtctaaacagcggaactgatcaagcaaaacgaacaatcaatgagctcaaagacaggctatttgaaaatacacagtcaaaggacaaaaaataattaaaaggaatgaagaacacttgcaagatctagaggactgcctcagtagaacaaatctaagagtcatgggccttcaagagagaaagagcaatgaataaaaagctcaaagaaataacagaaaatatttccaaacctacagagagatgtaagtatccagttataggaaggctgaagatcaccaaacagattcaacccaaataagactaccccaaggcatacaataattaaactctcaaaggtcaaagacaaagaggggatcctaaaaagagcaagaaaaaagaagcaaataacatataaaggagctccagttcatccgggaatatactctggaccagatgaacctacctgacattttacagaacattttatccaactactacagaatatacattcttcttatcagcacatggaacattctccaggatagactatatattaggccagaaaacaagtctcaacatttaaaaaaataaaattatattaagtatcttttctgactacagtagaataaaactagaaatcaatgacaagaggaacgtttgaaactatacaaatacatggaaattaaacaacatgctcctgaacaaccaataagtcaatgaagaaattaagaaggaaatttattgaaacaaatgaaaatggaaacaacataccaaaatgaatgggatacaacaaaagcggtactaagagagaagtttatagctataaatgcctacatcaaaaaagaaagactcaaataaacctggtaatgatgtaactcaaggacatagaaaaacaagagcaaaccaaacccaaaattagtagaaggaaaataataataataatcatagaaataaataatattgagaaaaagaaaacaatatgaaagaccaatgaaatttttaaaatggctttttgaaagataaaatttaaaatctttagctagactaaggaaaaaaaatgagagaagacccaaataattgaaatcaaagatgaaaagagtcattaaaactgataacacaaaaatacaaagtttcactagaaactattatgatcaactatatgccaacaaactggaaaaactagaagaaatggataaatttctggacacatacaacttaccaagattgaactatgaggaaatagaaaacttgagcagaccaataactagtaatgagattgaagcagtagtaaaaagtctggcattaaataaaagtccaggacctgatgacttcactgctgaagaaaaacttacaccaattatactgaaactatttaatattgcaaaaaattgaagagaaaagaatgtttccaaactcattctacaagaccagcattatcccaatacccaaaccagacaaagacacaacaacagcaaaaagaaaactacaggccaacttcgctgatgaatatagatgcaaaaatcctcaacaaagtactagcaaactaaattcaacaacacattaaaatgagtatttgtcatgcccaagggggattcatcctaggaacacaaagatagttcaacatatggaaatcaataaatgtgatacaccacattaacagaaggaaagacaaaaaccatatatttatttcaataaatgtcaagaaagcattgaataaaattcaacatcccttcatgataaaaactctcaacaaatttggtttaaaggagcatacctcaaaacagtaaatgttatatatgacaagcccacagctaacattacaccaaatgggaaaaaattgaaagcctttcctctaagatctggaacaagacaagcatgcccactttcatcaattctattaaatgcagtcctggaagtccaagatggagcaattaagcaaagggccttcaaattagaaaaaaagaaatcaaattccccttgtttgtagacgatataatgttatatttagaaaaacctaaacactccaccaaaaaactgttagaactgatcaacaaattcagtagagttgcaagaagcaaaaccaacatacaaaaatcagtagcatttctatataccaagagctaacaatccgagagagaaatcataaaagcattttcattttcaatagctataataaaaataaatatctaggaacaaatttaaccaaagaggtgaaagatctctatactgacaactgtaaaaccctgatgaaaggaattgaagaagacacacaaaaaatgaaaaggtatctatcccatgttcatagaatggaagaattcatattgttaaaatatcaatactactagatttcatgtattacctatcaaaataccaataacatttttcacagaaatagaaaaagcagtcttaaaatttgtacagaaccacaaaagacccagatatggtttggctgtgtccccacccaaatctcatcttgaattgtagttcccataatccccacatgtcgtgggagggacccagtgggaagtgattgggtcatgggggcagttttcccccatgctgttctcgtgatagtgagtgagttctcatgaaatctgatggttttctaagtgtttggcatttcccctgctggcacttattcccactgccaccttgtgaagaagatgccttgcttcccctacgccttccaccatgattgcaagtttcctgagacctccccagcaatgcggaactgtgagtcaattatacctctttcctttatagattacccagtctccagcagttctttatagcagtatgagaacagactaatacagtaaattggtaccgaggtagggggggcactgctataaggatacctgaaaatgtggaagcaactttggaactgtgtaacaggcagaggatggaacagtttggagggctcagaagaagacaggaaaatgtggcaatgtttggaacttcctagagacctggagggctcagaagaagacaggaaaatctgggaaagtttggaacttcctagagaatcattgaatagctttcaccaaaatgctgatagtgatatggacaatgaagttcagactgaggtggtatcagatggagatgacgaacttgttaggaataggaataaaggtggctcttgctatgctttagcaaagagattggcagcattttgcccctgccctagagatctgtggaactttgaacttgagagagatgatttggggtatctggcagaagaaatttctaagcaacaaagcattccagagtgacagagcataaaagtttgaaaagtttgcagcctgatgatgcagtagaaaagacaaacccattttctggggagaaattcaacccagctacagaaatttatataattaacaaggagccaaatgttaatcaccaagataatggggaaaatgtgtccagggcatgttagagaccttcgcagcagcccctcccatcacaggcctggaggcctaggagggaaaaatgctttcgtggcctgggtccagggctcccctgcagtgttcagcctgggacttggtgccctgtgtcccagccactccagctataagaggccaaagtacagcttgggctatagcttcagagggtgcaagcccccagcctttgttctgtgggtgcacagaagacaaaaattgaggtttgggaatgtccacctagatttcagaggatgtatggaaatgcctggatgtccaggcggaggtgtgctgcagaggcagagccctcgtggagaacctctgctagggcagtgaggaaaagaaatgtggggtgggagcccccacacagtcaccactggggcactgcctagtggagctgtgagaagagggccactgtcctccagaccccagaatggtagatccactgagagcttgcaccgtgggcctggaaaagccacaggcactcaatgccagcccatgaaagcagccaggagcagggctgtaccctgcaaagctatgggggtggagcttcccaaggctgtgggagcctgccttttgtatcagggtgacctaaatgtgagacacggagtcaaaggagaacattttggaactttcaggtttaatgactgccctattggatttcagacttgcatggggcctgtagcccctttgttttggccaatttctcccatttggaatgagtgtatttacccaatgcctgtacccctattgtatctaggaaggaactaacttgcttttgattttacaggctcataaacagaagggattttccttgtctcagatgagactttggacttggacttttgggttaaggctggaatgagctaacactttgggggactgttggaaaggcatgattctgtttttaaatgtgaggacatgagatttgggaggggccatgggtggaaacatatggtttggctctgtgtccccacccaaatctcatcttgaattgtagtatattgtttgtaaaaattcctgcctatccagagattttttaaaaaaaaacaatactttcttcaattttctcttacaatttaattttttacatttaactttttaatacttcctgtagactaaaagttattttggtgcattgtgtgaaccaaagatcaaagtagttttatttttttctgaaaacatctattcattttttcaattaattgattgtttatattaaggatctaggaggatctaaaattatggaattgtgggcaagggcaatttttgccttacatttcatgtaaggcaaaataatccccatgtgtcatgggagggacccagtaggaagtgattggatcatgggggcaggttcccccatgctgttctcatgacagtgagtaagttttcatgagatctgatggttttataagcatctggcatttccccttctgtcacctctccctcctgccaccttgtgaaaaaggtgccttgcttccccttcaccttccaccatgattgtaagtttcctgaggcctctccagccatgtggaactgtaagtcaattaaacctctttcctttataaattatgcagtctcaggcagttctttataccagcaggaaaacagactaatacagaccctaaatatccaaagcagtcctgagcaaagagaacaaagctggaggcatgatgctactttatttcaaactatactacaaagctgtagtaaccaaaacagcatggtactggcataaagacagaaacatatgccagtggaacacaacagagaacccagaaatgaatccacacatttagagccaactcatttttgacaaagtgccaagaatatgcattggtgaaagaatagtctcttcaataaatgatgttgggaaaactggatatccacatgcagaagaattaaactaaacccctatctctcactgtatacaaaaattaaatcaaaatggattagagacttaaatatacaacctgaaagtatgaagctactggaagaaaacattggggaaatgctccaggacattggtctgggaaatattttatggcctgggaaatatcaaaagcacagacaactaaagcaaaagtagacaaacgggattatatcaagctataaagcttccgcacaacaaaggaatcaattaacaaagtgaagggacaacctacaggatgggatgaaatatttgcaaactatacaactgagagggtattaataaccagaatatataaggaactcaaacaagtcaatggcaaaaaagcaaaggatcctattaaaaatgaacaaagatctgaataaacatttctcaaaagaaaacatacaaatggccaacaggtatatgaaaaactgctcaacatcactaattaccagataaatgcaaaccaaaagcacaatggatatttcactccagttaaatgacttttatcaaaaagacaaaaaataatgaatgctgatgaggatgtggcaaaaggggaatgcttgtacactattggtgggagtgtgaattagtacagatactatggaaaagagtatgtatgttcctcaagaaactaaaaatagaacgaccatgtgatccagcaatcccactgctggatatatatccaaagacaggaaatcagtgtatcaaagagatagttgcacaccaacatttattacagcaccattcacaatagctaggatataaaatcaacctaagtatacatcaacagatgaatggataaagactgtgtggtatatatacacaatagactattactcagccattaaaaagaatgaaatcctgtcatttgtggcaacatcgatgagcctggatgtcactgtgttaagtgaaataagccaggcatagaaagacaaatatcacgttttcacttacatgtgagagcttaaaaagtggatctcacggagatagagagtagaatggtgcttaaaggagtttgggaatggtatgggggggtgggatggaatgaagagaggttgattaataggtgtaaaatgaaggggtggcctgcccctcgtcacccacagtgacgagaaacactgtgggtgtttctcgtcaggtgggacgagagactgagaaaagaaataagacacagagacaaagcacaggaaagaaaagtgggcccaggggaccggcgctcagcatacggaggacccgcgccggcactggtctctcagttccctcagtatttattgatcattatctctaccatctcggagagggggatgtggcagaacaatagggtaatagtggagagagggtcagcaggaaaacatgtgaacaaaggtctctgtgtcataaataagtttaaggaaatgtgctgtgccctgatgtgcacgtatacaaacatcttggtgcattaaagagcagtattgccactagcctgtctcacctccagccttaaggcggttttctcttttctcagtaaatagaacatacaatcgggttttacaccgagacactccattgcccagggacgagcaggagacagatgccttcctcttatctcaactgcaaagaggacttcctctttcactaatcctcctcagcacagaccctttacgggtgtcgggctgggggacggtcaggtctttcccttcccacgaggccatatctcaggctatcacatggggagaaaccttggacaatacctggctttccagggcagaggtccctgcggccttccgcagtgtattgtgtccctgggtacttgagattagagaatggtgatgactttttttattattattattatactttaagttctagggtacatgtgcacaacgtgcaggtttgttacacgtgtatacatgcaccatgttggtgtgctgcacccactaactcgtcatttacattaggtatatctcccaatgctatccctccccccaccccatgacaggccccggtgtgtgatgttccccctcctgtgtccaagtgttctcattgttcaattcccacctatgactaagaacatgcggtgtttggttttttgtccttgtgatagtttgctgagaatgatggtttccagattcatccatgtccctgcaaaggacatgaactcatccttttttatggctgcatagtattccatggacaagcatactgccttcaagcacttttttaacaaagcacatcctgcatagccctaaatccattaaaccttgactcaacaccgcacatgtctctgcgagcacagggttggggctagggttacagattaacagcatctcaaggcagaagaatttttcttagtacagaccaaaatggagtctcttatgtctacttctttctacatagacacagtaacagtctgatctctctttcttttccccacagtaaaattacacttaaatagaagggataagttgtagtgttcgatattacagtagggtgactatagttaacaatgatttattgtatgtttcaaaatagctagaagagaagactgggaatgttcccaacacaaataaatgacaaatggttgaagtgattgatattccaattaccatcatttgattattacacattgtattcatgtatcaaaatatcacatgtatccccaaaacatgtacaattatcgtgtatcaatttaaaaatacatcatgataggcacctctcaggttgactgtactgtcctgattattgctagtggtgttaacaaatttgaagctagtatctttaagaacgggcagacccatgagcatgcccttctggtttacacactggaagtgaaacaactaattgttggtgttaaaaaatggatttcactgaactatgccatcgccaacagagctatgtggaaatcaataaggaagtcagccctacattaagaatactggctacaaccgcaacacagtagtatttatgccaatttctggttggaatgctgacaacttgctaacatgccttggttaaagggtggagagtcacctgcagagatggcaataccagtgtagcacaccgcttgaagctctggattatatcataccaccagctcatccaactgacaaggcttgtgcctacctctccaggaagtctacaaaattggtagtattggtaatgtctttgtgggcctagtggtgactggtgccctcaaacccagcatgattggtcagctttgctccagttaacattacaactgaaataaagtcttttgaattgcaccatgaagctttaaatgaagctcttcttggggacaatgtgggcttcagtgtcaagaatgtgtctgtcaaagatgtttatcatggcaatatggcttgtgacagcgaaaatgactcgccaacggaagcagctggcttcctgaaccatccagcccaaatcagtgctggctctccacctctgttggattgtcacacagctcacattgcttgcaggtttgctgagctgaaggtggttgatttccttctggttagaagctggaagatgacccccattgtgatttttattgctatggtttctttctaatttagtcttgaggtctctcccttgagaatggtcataagccaagagagccactttctaggagagtcctgaccagggggaaagttaagtttgagtgtgtcagcttggtgagacacaatgaggaagtaaaaacaaaataaatagtggaatagaatactaacaagtacctagaaataagtctagctaaaaatttgcaaaatgtctatggaaaaaaaaactatggaaatttactgagaaactttaaagagtacctaaataactttcaagatataccacgtacatgaattggaaaacatgatatttgaaaatgtcggttattcccaaactgatttatagattcagtgcaacctgaatgaaaatcccaagacgttccttttgtagagctcaacaagctgattctaaaattaatatgaaaatgtaaaggtttatgaatagccaagtccttcttgaagaggaagaataagatgagagtaattgctgtctaatatattgagacttattttaaagctataataattaaaacaatgtagcagttggtatagggataatcaaacaggtaaatgaaatagaatagaaaatccaaaactagtctaacacatatagaaacttgatttatgacaaaggtgtcacagaagtagagtttcaataaaatgctggaaaatgttggtatctatatagataaaacattacattggattcctaactcacaccatacacaaaaatccattcacattgcattacaagtctaaaagtgaaatataaaatcataaacattttagaaagaaaatgtaaaagaatatatcaataaccacagggtagggaaagaaagagaattgacatcaagatacaaaaagccctagccaataaggtttttttttataaattccacacattaaaattacaaacttatgctcatcaaaagataacataaaaacaatgaaaagattagccacggaatggtaaatgtttgcaatacataacacaaaggacacacaaaggaaacttatataatagattttaacaggcttctctgtgtccttcttctccagcaatcaaggaatatataaaaaagcatatcaaggatatatagggtactcttttgattcaacaagaaaaaagcagattatccaagagaaaacttggcagaaaaaagcttggataggtgctccacaaaagaggacatccaaatgactgctactcataagaaaagatgctcaacctcatagaacatccaaaaatgtaaaaacacagtcaataccagatatttgtaataatttggagcaaatggaactctcatacattgctaatgaaaatggaaaatggtccagctgctttggaaaacagtgtggcaatacctaccaaagccaaacacatgcatacctagtaattccgcccaacagaaatgcacatatatgttcaccaaaagatatgcaccagaaggttatagcaggtccatatgaaagtgccaaagattataacaactcaaatgtccgtgattagggtatattcatataatactatacaacaatgggaatgaacaaactatagctacatatgataatatagatgaatctcacaaccagaatgctaagtgaaagaagaaacaaaagaatatatgtagtatgttttatttacacacttcaaaacaggcaaaactaaactatatttttaaaggatgtatacgtaactggtaaaattataaagaaaagcaaagaaatgattatcataaagatcagaatggtggttaccttcagtgggaagggagaaagtatgattgaaaagggacatccagtgagtcttgtgggttgttggcaatgttactgatctgggtgatgattgcatttatgtaccaaaggcatttgtgttttatgcactttattgtatatgttttagttcacaatttttttagttcacaattttaatagggctttaaaaagtaaaaagaaaagagatccaagggcttgaccatgggactctcttatatttggagtatgtttataaactttacattcattcaacattcgacaaatattttttgagcacctactttgtgccaagcaccgttacaggtgctgggaatacaacagggaacaaaacagacaaaaccccagctttcatggaacttacatgctaataaagcttggcaagagtatttcaaggaagatgaagtggttaactatgcaaaatgcttctcaggcacctaggaaaatgaggatgtgaggcatttctacccacttggtacataaaattattgcttttcctctgctttttttctccagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtgagttaaggacagtggaattacaagaaaattaattttatatatttattttcttgctgactataatgtattcccacttttggaaatttttaaagtatagaaaaataattccataattatctttgtgtacgttctatttttcctatgtatttttctccttatgtattcaaattataccatgcagaattctgattcttgtttttttactaaatatcacatcataaacatttcttacgtcattaaaaacacttcctatgtatgtttttaaaatactgcataatagtctattatatgaatttatggaaccatagtttatgtaaccatttattttgaacaagcttttagacagtttcttttttcactatataaataacgctgtaatcacaacagtttttctaagataaaattccagaagtgcaatgtatttgagcatcttaagagtttttcttattaattatttggtaatgtcccttgcacatttgtctttcatggaggaagtgcttttcttattgattatgttaccttatatattagatagtaaaccactgaacattttaatgagaggtactttttcaagtttttgttttctcttaattttataaatgatggtttttgaaataaaacaggttttaatttttaggtagtaacccatcaatctttactttttgacactttcattgcttttatgtttataaaaattcctgcctatccagagattttttaaaaaacacctatactttcctcagtttttctcttacagtttaattttttacatttaactttttaatacttcctgtagactaaaagttattttggtgcattgtgtgaaccaaagatcaaagtagttttatttttttctgaaaatatctattcgttgtttcaattaattgatggtgtatattaaggatgtagaaggatctaaaattatggaattgtgggcaatttttgccttacattttattttactttccattatattctatgataaatatgtataatttttaatctggaaagtaagccttttttaaaagataatatgcattcattctagaatttgtcatgaagaaccttaacttacatatcaactcctggcgttatggtctcttataacccctgcagtaacattttcccttttactctggaatggcttttatgtgtttaggaattttctcctttgcaactttgagttcataccttaaatttagaatacaaaacctcctcaggattaggtttgagttctaacagcatccatcttctgtaccacttcttccagggtattaaaaactttgataaagaccaaaagacaggtatttcttttagggatgtaaaccctaaggaccttaagatcctagaagattattcttgcttttttttttttgtcgttattgttctacaggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggtaagcaggtgtctattgtgctgaccactttttggtttaaaagaaatggtctttgtgtactaagaattttgatatttatcctacgtgcaataagaagctttaaataggagagttgatcattatatttgtgttttagaaatgtcattctggaatctactgaagaggatggattatatttttggaaggtgggaggcaggttggactggcataaaaattgatgagaaatccactctggttcataggtgagagagcttatactcataggattgatgtcttccctccctaggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatggtaatatattccacatccaaacattatcactgtgaaatgcagattgcactttgacaaatgagacttgatccagggacttgaacattgtatttatttagagtatatctgtgggagtggaatcctcatagatgtcagtttttttggtggagtggagagaaagaaacttatataatagattttaacaggcttctctgtgtccttctccagcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtatgagcttgtttgtgctctttcttctacctactctatttgttgagtacttactttaaatggtctaggcactgggaacacaatcagtgatcaaagcagacaagctccatgctcttaagtaatactttttcaaatgctttttaaaccatttgttcaaagcaaatgaacaagataatttcagatatagaaaaattgctaaaaaggaaatagaacagaataaatggataattaatgtcacagtactttcctagggaaaaggaatttattcctttatcatttaccatctcaaatcccatagggcaccagtagtcatccaaagagtcatttgtttatgtatgtaaccagtatattgattaagcactactcataatgttgatcacaacacaattttattttggttcttcactgtccctttaaaatagatttggccaggtgcgatggctcacacttgtaatcccagcactttgggaggccaaggttggaggattgcttgaggccaggagttcaagaccagcctgggtgacaaagcaagacccccatctctacaaaaaataattagccagacatgtggtatatacctgtagtcccagctacttcacctacttgggtggctgaagtggaaggattgcttgagcccaggaggttgatgctgcagtgagctatgaaagtgccactgcactcaaacttggacaacagagcaagaccctgtctctaaaaaaaaaaaaccatccagtttaatagcgggggtaaactttccttatttcttcgtaaaaattctgataagccctgtaacttttctgctcacccttaagtaataaacaggactaaagtcactttatgtcacaaatacagttcaaatcagaaattacaatgtccatcccaagatattaatcaaaattgtaaacttgatttaacttcaatctcccctcctccaacttgagcctgcatcaggctggaagtctgcattggaaaagggagacatggttgagtcctctgtttctgtaccttgtgatgatcgtgcttccccacaacccctttatagctgctgttttgaactccaacatggataggttaaaggtaaggggataagatagttcttacctatttacagctggcaccattgttgtaaactagcttaacactgtttgtgcctggcaatacttgttgactctttctcctgcagggcactttcagggaactctttagagactcccttacgtgactgtcatgaaatccccttgacatgatttcttccacctttactctgggtggtcacttgtgactcatttctcagccctcagtgttcacctgcagcttcttgttgctggggtaactttacccttgtaggcagctctagtggactggatccagagggaactcaccctgacttatctgtttcacagagtccacatctggccaatgggaaacacaccttttgctcagaaagaccctgggaatgtaggtcaatcataatgcagtagcattctcctgtcccaaccatcaaagaattcagtcaccctgtttctcatctcctggggggaggggagtggtcagaactcaatctccacaacccccaactgtaagggtcacgtagcaagcactttgcatttgaggggtccaaaagtagtggaactaccaaatttggtaggtctactctgatatttcgcataaaccaatgtatctcatgctcattttttagtgaaaagaaataatttctgttcctgttggtttttataaggtgtttttgagacagtggaaatgttaccatccaaagctggaatttggcgggtggaatgccttattggcgagcatctacatgctgggatgagcacactttttctggtgtacagcaatagtgagtagcaatgtgggcagaggttccctacctactcagcctacttctttacagctttcttcctttctggaatggttgcttgtgtcaggaaataaatacaagtttacatcattatcaaatttaaaatgaatattgctggtagaaatcatcagagttctcagagtagggcagatatacttgaagctttgaacactttgtacctgaagctctaaataattgacaaaaaaaaaataccacctcattttcacaacttggtaaagctcgaagatctccagtagcagattttggaatttaatgttgatttagttaccagataacttagaaatactacttggaagagtttggagatttaaccctaaacaagtaagagagccactggtctatttatgtacggaccccagtttcttcagctgtaaaatgtgaatcattctagcacctgttaggattaattaaatgaactaatacagtaaaacgttgagtacagttcttggcacatttaaacactaaaaaatagcatttgttgacgttctcccattttcattgacttacatttgagaagctgaattttgtgcacttctagttactgtgttccacccgtttcatttcagagtgtcagactcccctgggaatggcttctggacacattagagattttcagattacagcttcaggacaatatggtaaatactattatttttgctccaagaacctgggctgattatatctttttttaataatctggtggagaatctcagataatgaatccatctccatgcttctattagttctattccataagtgcctctcaaatacatctcctcctctccacttcccactgtggccatcttaactcaggtcaccatcatttcttacctgggcaatgacactgcctccttaaatatcctccctaccttcagtatttcttccttgagtcaattcttttcagtgcagcaggaagctatactttcctatgagcagtaatggtaaagtttgactagggtctatagagaattctcagaaattgttttagagcactactgcccacaggctaaatgcagcacactgcctgtttttgtatggcatgtgagctatgaacagattttccatttttaaataattgtcaaaaagatgaagactatttcatgacatgtgaaattataaaattcaaatttcagcatccgtaataaagccttattttggaacacagccacgtccattaatttacatatcatctatggctacagcagcagtaacatagttgcaacagagaccatataatatgcaaagcctaaatgatttactatctggccctttacagaaaaagtttgccaacctatgttgttgtgaggtaaaaaaaaatcctcttgaaaaggaggcgtgagagttttacaccaaaatagtaacatttttcactaggtggaagggttacattttaaaatgtcttttatttgtatttttactaatttttacttttcattttctgatttttctacaatgaacatacattgcgtaataaataataggcggggcacgttggctcatgcctcccagcactttgcaaggctgaggcaagcagatcacctgaggtcaggagttcaagaccagcctggccaacatggtgaaactccgtctctactaaaaatacaaaaattagtcgggcatggtggtacgcgattgtagtcccagctacctaggagactgaggcaggagaattgcttgaactcaggaggtggaggttgcagtgagccaagatcatgccattgcactccagcctgggtgacaaagcaagactccatctcaaaaaaagaaagaaaagaagaaataatattattatttggtagtgttggtaacaaattgcagtatcagctagttagaggtgctaacaattaacaaaattataaattttagaaaataaaatggacaacaaggataagcaatatccttagatagtaattgatactggtatgccataaagcctttatgtttttctctattttcaccacagcttagattaacctttctcaagacaataattttattctcaagtgtctaggactaacccagctgaatttaatctctgtttctttacttgggcaaaggacagtgggccccaaagctggccagacttcattattccggatcaatcaatgcctggagcaccaaggagcccttttcttggatcaaggttagaaaatgtaatcaatgatgggaaatgtatcacattcaatcaattgcattacttattcctcttgcaagctcaaaggattctatgaatatgagaaaactaaagaacagaatgccttaatgatttgtacaaaagcagtcatgaacaaagagatatggggatagaattgagtatattgatatgtcctgtttctgtattttagtccttctactgggattagaacatctgaatattttctataatattgaactcgtcatctctcaagacagtatatgttattattagatgcttccaactgcccacgtgtccttaagtactccaatcccctttattttaacataaaacaaatggttcacaaatgcaaaccacatgtgtacttttacattttctgtagccacgttttcaaaaatgtgaaattcactttaataatacattttatttaactcaacatatctgaaaatactatcatttcaacatatgatcaatgaggccccttcaaagacagacagatggaaactcttgggtctcttccatgcctcacaaaagctgagggcagcttggaagtgcctgctcagcctctccacctaaacataaggctagatgccttctagaagcccaaacaggaaatggagaaaacattttggtttccatctttgcaaatagcatgtctattaatgccacagcattgttttgtagacactgccaattttgactcaatctgagctgctgttcactaatccctaagtattttttgttggtttgtgcttctgccaaacaacatgttatgttcttcaccttgtatttctatggttattttcaaccttaagtgtatccctatatagagaacatgtttatctatttggccaccctgtgtctgtctgtgctatttaattttttgtaataacattcttatttgggagggcggaattatatcttcctcactagatacaacctgataagactagtaaatagagtgtcctgtctgtgcctagccaatgaaccctgaatgatatactctgttgtttccacttactagatttggcccattgtttcagcttgccgatcttcagtgtcccaaagtatttcctagtttttccagttactgatttgatcagtaaactttctaatactgcagcaaagtcatgatcaaaatattgaagtagacaagacttccttagtatgtgcacaatacaaatcaagctgttaagtccttactacaaccttgtgaggtagatgttactatcatcttcatttcagataatgaaattgaagcatagagaggttattgtggcccaagtcacatggctaataagtgactgagccaaaattcaaattctgatagttgggctccagaaccctaactggtaatcgttgtactacactgtttccggaatgctccctttaagttgataaccatctattaactgtcactgttcacttgtggtaattaaaccagttacaaatccacctagttatgttatcatctaccactattgaatcgccttatcttcaaggtggttttgccatctgtcctactaaggtccagctagactttttatagatctcgtaactttataaaataaaccatggagatggagttgaaagggggtgctgacaaggaagggagttggagaaggcatctattctcgtgagaaggcctgaagagtgcacaacagcctggccccaagacacaagagcactgggctggcttgaggagcaccaggtgaccaagaccaggcaatgcacagggggaagtcagcaggccccatggagatacgcagctgcagtgtttgtacttttatacagtgaaactcattaccaccttgcttacttcctagtagagagatgtgtcttgtagttacactgaaacacctggctgggcacataggtgaagctgttgagtctgtaattgtcaaactgctcccaggtgccaattataatgtagaagaggcacaagaagatgaagtggataagcctggcagtttgtcaagcattcatcagttgtcaagcatttgtcagttgcagaatgtaggtaggctgccaaggctttattgtagcctggttctattgcagctttattctagcaaggctgctggaaaatacaataatcactggtccaagaaagaactcttatactctatctatatgaagaaacagtaaaagtcaattcagtagaaatcatgatttttgtgcctggtgctttcacttttttatgccacaataccaagaggttaaaatgaagtgtctttgattgggaataccatctatctgggaaaagacagggctgcaacttctgaagaccttgacactctgtcctgttaccctgcttcatttttctcctgcgcttatcactacttgatgctataaacaaataaaaacatatatgatataaggtctatttctcctactcaactgtaagttccatgagggcagggctttctttcttgtttactactctattccctgtatctaaaacagtgcttggcacatagcaagtgctaaaaaatattctttgaatgagtgtatgaatggaacttacagtcagctgaaggagacagttattaagcataagagtgatgaccagtccaattgtgtgtgtcaggcatgtgtgaaaacgtgctaaatttgacttgcttattaggacagtaactgatacttctaatgttcttgcagcccatgacctcttctttaagaagtgtccattctgtactactttcccattattcactcattcattccaaagcatttgctatacagcagtattataccagataccatattaggtgctggggctagagagaatataaaagctaacattgattgagtgtttagtatgcgccaggccctgaactcagcacattacatgtattaactctttaacccctatggcagccctttgagataaaaactaatattatcttcactttacagataagttgagacacagaaagttaggtgactcaaatgggttcactgccttaaggatctcagtctaataaggaaagcagaaaagcaaagcaaccttataatatggtgcaataatttgctataatgaagttatatacaaagtgaagtagaagcatagaagaagcagcactaaatttgtctgggtgagtcagagaaggctaaccaggaaaaatagtttctgaactaacacttgaaggaggtgtagcagttcatcactgacagtgatgttggggtgggtctggtttcaggagaggggaggaaattggctttggtctgaggctgaggtgtgggcaaagcattagcttatgtgggtccattagcttatgtgagtccacaaaaggtgtgtgtgtgtttgtgtgtatgtgtgtgtgtgtgtgtgtgtgtgtgtgtgtacgaaatgggggctcaatgatttggtagtggtttggtttgtcaagaagcaggctgggaactcaataagcatctttccattcatttctactgtgtatcccacagcttcacacacacatgcacatttcaacattggtgactgcttcacttgcacacctaaggtaatgatggacacacctgtagcaatgtagattcttcctaagctaataattagtttcaggaggtagcacatacatttaaaaataggttaaaataaagtgttattttaattggtaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtatgtaattagtcatttaaagggaatgcctgaatactttaaagaattttggcagatttcagatattggacaaacactcttagcttccacaaacttaattccaaaaaataatttttcacttatgagcaatagagttattacggacatatcagcaaaaatgtagtagtgtcaaggctcatagatgatagaaatgaagagatgctgtattgatagaaatatgtgattcaggactgtgtggattgatgattgtgagcttgcttatggatatcctaggtttgaggttatagtaggacaatcaggttgaaatgtccagcaggcagtaggtgaaagacaagtttagggggcaaaaccatggatggagatgaagattcatgacttccacataaaaggatgggtgaaactttgggaattgatgaattctctagaggtgagctcaagacccttaaaggcttaaaacctcagcgttattgtctactcttccctcatttttatgcccacaaatctggtcaatcctttatttgcaatgcctctcacatctctttcttctgtttccatttataccgctgttgccacagcccagggtcccatcacctcacacttgatctattgtattacattcctaactagtcttcccccgtttctaatctgttctccgataaaagctgcacatcattttcaggataatcatcagtcgcctgcctaaaacttttcaatgtcttcccattgtctttagaataaagttcaaagtcttcaaatgaccccaagcaagataacttttgtttgcccctttagatccattttcctgcttctctaccctgcttcttgttctgtgaggtgagcttgtatagaatacatcaacaggttaccttgtcctccagcttttggttggatttcaccaacagggagcactggcaaaagattggcatatttattcttctgactttctccttgcagaggagttcactgtatctccccacttaaggtcactgtttccctcagagtggctttttctacctgtactagctactattgctgtgtaccaagccacttcaaaacttgctgtcataacaataaccattatgttttgctcacagattctgtagatcaagactgggacacagtggggatgggtggtttctggagcctcagttaggattatttaacagctgggtgctggaatcatctggaagttccttctcttgcttttctggtggttggtactgactgtcagctaggacagaatctggggttgttgactgatgtaactttacatggattatccctgaggcctggccttccttacagcatgtttcaaggtagttggacttctttttgagggggggtaggaaggtggggggaggacagagtctcactctgttgcccaggctggagtgcactggtgtgatctcggctcactgcaacctctgcctcccgggctcaagtgattctcctgcctcagcctgctgagtagctgggactacgggctcatgccaccacacccagctaatttttgtatttttagtagagacagggttttgccatgttgaccaggctggtcttgaactcctgacctcaggtgatccgcccacctcagcctcccaaagtgctgggattacaggcacccggcctgtagttggacttcttacacgtcattttagggcctccaagtgtgagtgttacagttaacaaggtgaagactacataaccttttctgaccgagtcttctaagttatgtagcatcacttttgttgacaaaaagtgttgaactctataaaatatttgaagagatttattctgagccaaatatgagtgagtatggcccatgacacagccctcaggaggtcctgagaacatgtgcccaagatggtcagggcacagcttggttttatacattttagagaggcttgagacatcaatcaaatacatttaagaaatacactgatttggtccagaaaggcgggacaactcaacctgggggcttccgggctataggtgaatttaaacattttctggttgacaattggttgagtttgtctgaagacctgggattgatagaaagggaatgttcaggttaagataaacattgtggagaccaaagttcttttgaagtcttatagtggctccccttagagacaatagatgacaaatgttttgtattcagatcttagttaatctctttaggattgggaggggctgggagaaaaagatctagctatgttaatagagattctttacagttgcaaatttccctccacaaagaacagctttgcagggccatttcaaaatatggcaaaaaaacatgttttggggtaaaatattttgattttcttccttgtctcataatgttatgccagagtaaggttggaaagtaaatcatgacatataaggttaaataaaacccatctgatgagaatttatgatttgtagggcatgactccccagaccccttagataggaatttgggcaagataaaaaaaaatcagagtttagtcctcactttcaatacattctattggttataagcaaatcgcatatccacccagattcaaggggaagagacatagaccctaatttttaatgggagaaatgttaaataattggtggtcattttttaaagccactacaataatctatccaattctctctttcaggatgtttctctcttctgatcctttcaggtttagggattgtcaacaaacaaaaagttaaaccctgtaaaatacttgaagagatttattatgagccaaatatgagagaccaatggcctgtgacacagccctcaggagatcctgagaacatgtgctcaaggtggtctggctacaacttggttttacgcattttagggagacataagaccgaaatcaatagatggaagatgtacattcattgagtttggaaaggcaggacaactggaagcgaggcggggcttccaggtcgtaggtagattcaaagattttctgattggcaattggttgaaagagttaagttattgtgtaaagacttagaatcaatagagaggaacatcggggttaagataaggggttgtgaagaccaaggttctgtcatgcagatgaagcctccaggtagcaggcttcagagagaatagattgtaaatgtttcttatcagacttaaagagtctgttctatcagtctgaaggtctgtgttgatgttaatgctggtcagatttttctgaattccaaaagggaggcgggtataataaggcatatttgatccccactttcccatcatggcctgaacgtttttcaggttaactttggaaggccctttgccgaaaggaggggggattagaattttattttgggtttacaggatggtaatactctgttcccaccctcctaactagtatctttattaaaccttccacaaattatcctaatttccatgttttctgttccttgctggatcccttgtttcatacagtaattggtgctagaagaaaccccaggaaacagattttcaaaatgcaattctaaggttatgttgctaatatattcaagaaacacagagataacatatttgccaaggaagaaaatgagcagttagggaatccatgacatgtgttagtattatagtttctcagattatcaccagtgatactatgggatgagttgcagatggcaagtaagacactggggagattaaatgacagtggcatttagtcactgtggcaacaaacgtagcattacctgattgtagagtggtctgtcttcttacagccctagagggcatacacatggaaaaagaaatgaaatgttatgaatatatacaaaataagaacactgatgaacatacatggaaaatcaggatgcatgcatagagcttttgaggaatactccgtatcctgtggttgtaggcagatacgacttaggggctgagcataagttgcagagctgcagtgacaattaaatgcttaactccaccagatctattatgctgtggtaagagtaccggtgggaaggagtgaaactctgaggcctgagatggaggcatttaggcagacatggatgaggctgagaattgcaaacctccaaattcccctgaacctcctttgcctgaggaggcaaccactccccagtctctgaagcagtcatccctcttttgtgtaaaagcctttcagtggctataactgagataggtgcctcacaaaccagtgactattctccttagagaccctgtttggacactacgaaagccaggcgagtcacagaaaatgacagcagatcacaaatttaatcaggtggtgatgccaaaaaacaattgcaattccagatatcatatctctgttgaagcaaatttacacagccccaggcacctgatatggaagtattgacctagagaatgttttttcttcatttccatacattagtaaaatcagaatacatttgaatttaccaagtaggaacaagagtattaagtttactgcccatgcatcagggcaatgttagctctcttgttttctatcataatatagactcaagggacctcaaacatctttacatcccacaagcacaatgcctgtccattacactgatgacattatgctgacaggatctggtaaacacataacaaataagcctgtcttgctcttgactttaatgagaatgtaacctgtgtttcactgtttaatataatgttcactgttagtttcaaatactttttatgatgtttaaaaagttttctcctatccctattttatttgcaatggcaactgaattttatcaaatgcttttccagcatctttgacatggtcacatttctcttttgtgttgtcaaattatacttaacattcaatagtgtgctgacaagaaattaacaacccacaggggagcaaagtgagaagaggttaagaagtaaaggccttgatttatagcattggcagatttccctgacataaatactactcccatcatgcctggccccagggatgggaagagatgcttacttacaattggctctcacagaccagtgcaagagcactactgtgctccatttctgggaaaactttcgtcagtcatagtgtgttagttatttaaaacttagctggatccaatttgccaacatttcatttataatttctatatctatattcatgaatgaaatgggtttagctttttcagtagctctacttaccaggttttggcatgagggttatattaaacttgaaaataaagtgggaaagcttccatttttttccatgaagactattgctctagaatagcttatttaatgtaggaatccagtatttaatgagagtaaatgaaaaagccatatgagccatgtgctttatttagtgagagatactaggctatattttccaatcgttatatgattattgctattctcatttgtgttgccttgagttaatgtctgcaaatgtgcacattagagtcatatatcccttcctgtgccatacatctatatctgtatacacacatatgtcttttctccttttttcccttctgtatcaagagttggcaagtgtttgtctattctattaatttttcaaagaatcagctcagttttaaacccaaacgtggttttgaaagagctgtttctagttcatcaatctctgttcaaaactttaaaaattctattttcctttcttttggtttgtttcctacaatctggaggtgaatgcttagttcacttattcttcaatctttgtattttaacgataaggataaattacttacagttattaactactctcatgaggttcattccttgaacagtcactgagcaactactatgtcctgggttctaattcaggggtgggcaaactatagccccagaatttggcccatagcctgcttttgtacggactgtgagttaagaatagtttttacacgttgaaaggattgcaaagacaaacatacaaagaaacaaagaagactgtgcaacagagaccacctgtggtctgtaaagactaacacatttctatcccgcccttgacagaaagagtctgtgggctgctggtctcctctaacggtggtagagatgcctgcacggttaacattaatccttggcaccagaatcctcagcacctaggaaccagatcttgcctaacacgctaatttcagtcttgaccaccttcctccggcgtagcggttctcaaacgtctttgtctttgtactattcacgtataaaatattctttcataagcaacatttatccttttgggaatacctcacaatggggagaaggggaaccccaacagcctttaagggttcactgcttcgctgccaccatttccgacggtttacactgttttaagtgtgaatttggaattgttttcaagttaaaaagcaaactaatcatgtcctctgaaagtatttgcttttggcatgctagaaatcagtgttgacttttgatactgatgtgatacattacgagggaattctcaaaactgctgaaatctggcctcggcccagttatcactgctcttaagcttctgagggagatacatgaatgagcccacggcaaatggaaaacgaggagttttagtgtttcctagaattatgctcagatacccactacctgaccgtctggttatccttcccctcacctccctgacgcaaggagtttggaccagaggcctaaggaggcttctcctgaagcccaaatcccaaactggtcaccagtcatgctccgtaactcctgaacctgacaagaagccagccggccaggtctgcagcccgggttaagaggagcataccaggaaagagccaaagagcaaaggagcatgagcccttcaaccgcttttacaataatttgggctaggcgttcagggctccgtaggacccttcctggcagccaagtgagagaaagaggaatgatggtggaatgggcctctcctgtgcttcccattacttccacactgtcgaaatagaaatagaagcagaaaagaacaccctacaagtcccacccatttggaggcactcaactcacagtgacaaccctccacacctctcccctgcaaaaagacgcaaaacaaaaacacctactccaaactgtgtccttacatctcagccccgaagatcaggattgtgtgcaacttcggcccaaaggatgcatttccccagggttgaaagtttgagaaagaggctatattctgaagagttcttgttgtcaccatcaaaaggattaaaaagacgcaataaataagaaaacagcgtagttggggggcatgctccatttgagccagaaagccttggaaacttaagtgttctcaaacggaacgccatcctgctttgggggaacacggaggctgccttgcagtcacgtgatcgcacaacaccaaagggccacgcactctgatttcacctacttaactaaaagttgcagcaaaatccctattacaggccaggcgtggtggctcatgcctgtaatcccagcactttgggaggccgaggagggtggatcatttgaggtcaggagttggagaccagcttggccaacatggtgagaccccatctctattaaaaatacaaaaattagcccagcgtggtggtgcacgcctgtaatcccaggcaccctggaggttgaggtaggagaatcgcttgaacccaggaggcggaggttgcagtgagccgagatcacgccactgcgctcctgcctgggcgacagagtgagactccatctcggggggaaaaaaaaaaaaaaaaaaaaaaaaaatccctattacaaataaaagctgttgtgatccagactgcatatacctctgcgaatggaaccagaaccgtgaattccaatgcaaatcgatgcatcggcaccagacccgctgcactggatgtatctgcattgcagtcacccgagtacggagcacatcatagatgatctctgcaggttcgttgcccacataggaggcatagcgcaaatttcaaaggaacgaatacatcctggagcccaaacagctatctggttctgctgctggcctcctgacaagtaggtaagagagtcacattttatagacgacggacaccaaaaccacacatgaggagtacaagagtagctttatcatggatttagggctgtggttacaaggaagctgtaaggaataaaatgactcccatgaagacgtaccgtgcggacgagtggaaggagaaatttggccattacaaagacacaggaatatgttaagaagtgaggggcaggatgaaatcatctagggtaggtatttagagggagggcgccgtgcaaaataaaatcctcactatgaaacaaaggcggaggcaggaggctgcgttaggtggaagcagcggaggaaggagacgaaagggattgtcattttcatgtcgtggctttttagaagacagccatgtcctctactctgattctatcaaaatgtgttctcggggtgctggtaacgttcagccaacgaaataattcctatggcggcagtaggaataacaaaacgcagaagcgggaacgatgtctttttattcctccccagacgcaaacgtggatgcatgaggtttggtaacaggcaaagtcatctggttaacgtgactgatgcaaaaagtccaggcctgggcaaaaagaagtcactgggtgaatgggatggatcagactccctgtcctgagggggagatggtttcttgcagaacgaggtgaaggaggtggttctgctcagcagtcaacagtggccacatctccacctgcagcgacttgatggcttccgtgtccttttcgtgggtagccatgaccaaagactggagcagcagaaagagctcctcgggaagctggccgctgctctcctgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcgggagagggcgccgccgagccggagttcggaggaagcagcgcggccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtagtcgcgcgccagcagctggcaggaggcggcctcgccaagcgcctgcagcgcggccaggggcagctggggcagctggagctgggcggcgcgctggaagtgaccggcggcggcggccggctggcccaggtcgcgcagggcggcggccagctcgaggcagagggcggcggcggcggccggctggcccagctcgaggtgcagacgcaccgcggcgcccagggcgctggcggcggcctgcagcggctccccgtaggcggcggggcagaccaggcgctggcgcgcgtcgcgctcctgccgcaggaagaggcgggcggcctcggtgagggccagcgcctccccgggcccgtggaagagcgcctgctggcagcgcgccaccgccagctggcaccaggccgcgtagggcagacactcctgggcgcgcagctcccggcccagctgtccgaactgctcgccggcctccgccacgttcggcttccgcaggaaccgcttcttcagcttgttcgataccagccggtagcgggccaggaagtccccggcctcgggtcccgggccggcgccgccgccgcccaggcctgcagccgctgccgccatgctcgccgccccaagcacttcccgacgcgccgccgcagctggcgggcgggccggggcggggcgacgtgccctgcgtccccctcggcgggctgccgccgtgcccgcgccggctccccagcccgagcctgccccttgccctgatgaggtgcaaagagcgggatcggaggcggggcctggccgggctgtgagcggcgtatgcaaatcgagggtctcggggatgcggatccaagaccctgggaaggtacgcggggcctggcggggcaccagctgctgctagctcggctgcaatgcaagtggtctaggttgctaaaggcatcccacagcctctccatctgaacatgacccaaacgaaactcgtgaccctaattccatgtctgcgcatttctagactgttgtccccccccccccccgccccgactactcagtcctccgtcttccggtccagggccccttgccaagcaccgggtccacctctccgtccccaccccggttgccttagaagtccgtcctgtcgcaacactgcagtcatggtcttgaggcccacccgccccaacgaacaccatcatgctgaggactttcccgggcaggccctgacttgctcagaaccagcgggggtgtccccttcccacccagggccactcccctgcactgtcacccggagagactgctcctctgtgccatccctggctcccacccaaccccagacccccaccacctctccatccctccagctgtggaggtctcacaaccccccaacccatctcaccgcccccccacccccaccccaaggcaaagtgactgaagcgggcagatggcttccttgaaacattttattgacagaattaatgaaggcccaagactttggggcctgggttgtggggggagggtgtttaaggccgggggttcaggccgggggatttggggccgggtgggtggacgagtggacctgtcaggtcccaggggccgggtgtcagaagctagtcctcgccaggggccacttgagagatggtggtcgtgttgaaaagggtgctcagtagcctgtcgttgtgaaccaccatgtccagcagcaggggagtgatgttccgctctccgctgttctgggcctcgttgcccgccagctccgggaccttggccgtcaggtactcaataaccgcagcgaggtagaccggcgccgtgcgactcaggcgctgagcgtagtggccctcccgtagactgcgctccacctggctcactgaaaacgaaagctccgctcggacggtgcgagagcaggtccgcccccggccgccagcaccggaggaccctcggcgtctcctcctcctcggcatgctgggcgttgagtgtgctatctcggcttggcccagctaggcaagatggctctcaagaggacagttaccgcgtccagtactgtgtatcctagcgaccagggcccagcccctcattggctagggagccgagaccaatgggcacgcacatccggcgacgggcacgcatgtggtgacggcccctcacaagggacacacgtccgtcaggtgacctcatcactttcccattggcctcgagggagcaggcctgggcctagaagtggctggagggccgtgggggtggggtggggcggggcagggggaatcgcgctggtgaccctctctttgccagtgggaactttccctttctactggatgggaacaccgtgggaaagacaaaggggtgggcgaggggaggacgggtaccacgccttcacaatgttgcacatccatcacgaccacctagttccaaaacgttttcaacaccccgaaaagaaaccgaaacccctgtacctataagcagtcacttgccgcacgcctccttccacaccaccactaccagcccccacaccctcccacacacaccccctgcccccgcccatacacacgttcccgatagtccctggcaacccctagtccatctgctttctgtccatagaggttagcctgttctggagatttcctatagatggaattatacgaccaaatgtgaggccgtgtgtgtctggctgctttcacttagcgtaatggtttcatcagggtgcatccatgtagaggcatgaatcactacttccttcctttgaatgactgagtacgattctgttgtatgaataggaggccacattttgtttacccactcgtcagttgatggacaggttatttcccccttctggctattgtgagtggcactgccatgaccatctctctacaggtttttctttgaatatctcttttcagttcttttgggtctatttctagcagtcaaactgctggctcgtgtggtaattctgtttaacttattgaggaaccaccaaactgatttccacagcagctgtaatctttcgcattcccaacagtagtgcatgagagtcccaatttcttcacagcctcatcaaaacctgttttctgtttgcctcattttgttttgtttacagtagccatcctactgggtgtcaagtgctatctcatggtggttttcattcgtatttcccaaatggctaatgatgttgctgtggtttgagtgcatcccccaaattgtgtgtcttggaaacttaatccccaaattcacatgttgattggaggcgcagcctctgagacggtaattaggattagataaggtcatcggggtgagacccccaggatgcgactggtggctttataagaataggaagagaggcctgaaacgacatacacgctcttgccctctcgccgtgtgataccctctgccgtccccagatgccgggtcacttcccagtccccagaacggtaagaaataaatttcttttctttataaattgttcagtgtcgggtattcaattatggcaacagaaaacagactaagacatcttttcatgtgcttcttggccctctgtacctctgctttggaggaatgtctattcaagccctttgcccattttttaattcggttgattgtattttggctgtgggcttctaaaacttattcatatattctggaaaatagactcttatcagatatgtgacttgcaaatgtttctcccattcactttctggatagagccctttgttgcccaaaagatttacatttggatgtagtccaacttgccaaatgaaaagatatctgtggctttgcctttggtgtcatactgaaggagctgttgcctaatccaaggtcgtgcaaagttacatctccgttttcttcttagagttttatagtttcagcccttacatttagatctgtgatccattttgaattaattctttacatgatgtgaggtaggggtccaggggccttcttttgcatgtggctatccagttgtcccagcgcagtttgttgaggggattattcttcccctccacccattgaggggtgccggaactcttactgaaaataaactttacataaatatatgggtttattcctgactctgagttctgtaacattgacctaatgtatcgatcacgatggcagtaccacccttttcggattactgcggttttgtagtacgttttgaaattgggaagtgtgagtccttcaacttttttcttttctgagattgttttggctatctgagccccttacattttcttatgaattttaggatcagcttgtcagtttttacaaagaaggcaggttggattctgacaggcatcacgatgaatctgtatattgccttggagattatgggcatcttaacaatattaagtgtcccaatccgttaacacaaaatgcctttcgatttatttaggtcttctttaatttattttagcaacgtcttgaaattttcagagtatacatcttgtacacctttagttaaatttattcctcgacattttattgtttcgatgctactgtaaaatgaatcatttccttaatcttattttcatgttattcattgctagggtgtagaaatacaaccgactgttgcagattgatcttggatactgcaactttgctgagccgaatatgctttgctgagcatactcagacagggttggcatattagtccgttcctacactgctataaagaactgcctgagaatgggtaattcctaaagaaaagaggtttaattgcctcatggttctgcaggctgtacaaggcttctgcttctgggcaggcctcaggaaacgtgcaatcatggcggaaggcgaaggggaagcaagcaccttcttcacatgttggagcaggaggaagagagagagaacgcacgcaaagggggaagcgctgcacattttcaaacaatcatcagatcttgtgagcgctctatcagaagaatagcaagggggaagtccgcccccatgattcaatcacctcccactaggcccttccttcaacaggtggggattacaattcgacatgagatttgggtggggacacagagccaaaccgtctcagttttttttttttttcttttgttggactctttagtgtcctctatataagaacatgccatctatgcatctatgaatagagatggttttacttgttcctttccgatctggatgccttttatttctttttcttgactaattgccctgactagaactttgagtacgatgttgagttacaagtggcattcctgatcttagggggaaatcaaccagtctttcaccattaagtatgatattatctctgggtttttcatggatgccctctatcaggttgaagaagtttctttctgttcctggtttgttgaatttattttcatgaaagggtactgcgttttgtcaaatgatcctttttgtacatgattaagatgaccatgagccccctcccccgcccccgctccgccatgcattctgttaatatggtgtattatataaattgattttcacatgttgaaccaaccttacatttgtgggataaatcctatttggtcatagtgtataaagagtggtcaataaacatttcgttgaaagaataggagtggatctggcaagcttcttggaggacaatgtgtgtgttaaagaatctgtagcatgatgagaagccaaggcaccggtgggaggaggggagttgcaaccaattcattaaggctggagagtacgatgccagtggagcagtagtggttgatgtggctgggaaagaggtaggcaggagccaagacatggaggttctattatgccatgctcaggttttagaataccctgtaggctacactgaacccactgtggtctttcagcttgggagtgacgtggtctgatttgcctctagaaatatcaccctggaagctgtgtggagaatagaacagagaggattgtgtgtggagaatagaacagagaggactgagattggaattagaaagctgctgtattataccagtcaagaaatgacagatatctcaactaagacaatggcattggtagataagactaggggacagagtccataaaaagtttaggtagtaaaatggcacacagtagacactcactacatattactcatactggtgaacctagctggagacatgataattcatgtgctcattcttcaaaaaatattgaagggtagtgccaggtatactgtgttaagcattgagacaacaccaacgagaaatattctgttgtataaataggccacattttgtttatctactcatcagttgatgaacagttcattaaatgatttccatggcaggggaggtaaatgttgtcctctatcctcttagattctccagctaggacttaaataagatagattaacaaaagaaaagcatacaaaattttatttggcattttttacatgtacatgggagccctcataagaaatacgaagactcaagtgattaattacagctgaatacttacatactagggtgggaaaagtatggtaaattgtgaaaacataacaagacattggggtttgggctaggagagttaattgtggaaaagtcactaagaaggtaagagttgtgtaacaaggttttttggtgcagctttccctcaagcctggactccccatctctggcaataagaatgtgtttcttcttcctggtatacagataatacctttcacatcagagtttcatctcttcctttcatgaaaaaaaaaggaaggtcagtgtgcccttcttgcatctgctactttcaagtgcctttaaacacaaaataatcaatatgccaaagtggcatattttgaggtggcatttgatcccctacattactgattggatagtgtgaatagtgctgccatgaacgctcctgtacaagtgtttgtttgaacagatgttttaaattgcagacgctcctcaacttgggatggtattatatcctgataaacccattgttagttaaaaccattattagtgtaaattcatttaatacagctatattagtccattctcacactgctataaagaactacctgagacttggtaatttatgaagaaaagaggtttaatggactcacagttctgcaggcttaacaggaagcatgactgtgaggcctcaggaaacttacagtcccagcagcaggtaaaggggaagcaagcacgccttaccatggtggagcaggagagacagagagtgaaggacggaaatgtcatacacttttaaaccatcagatctcatgagaactcactcactgtctcaagaacagcaaggggaaatccacccccatgatccaatcacctcccaccaggcctctcctctgacacacggggattacaattcgatgtgagatttgggtggggatacagagccaaaccatatcagcggctaacctaccaatcatcataatttagccaggcctaccttaaacatgctcagaacacttacaattaggctacagttgggcaaaatcatataacgtaaagccaaatttataatgaagtgttgactatctcacgtaatttattcaatattgcactgaaagtgaaaggcagaatggttgtatgtgtactttaagtacttttatgcatatggattctactgaatgcatgttgctttcataccatcataaagtcaaaatattgtaagtccaaccattataagctgggaaccatccatatttgaggtacatacccatgaatatatttatgggtttatttcttgcttcttaattctattccatttatatatatgtctgtccttatgccagtaccacaaagcattgataactgtagctttatacgaagttttgaatttgggaaatgtgagttatccagctttgttattttttaggattattttggctatttgaggtcttgcacaattacacatgaattttaagattggcttttccatttctgccaaaaaaaaaatggccattgggattttgatgcagattgtattaaatctgtagatcactttgggtagtactatcatcttaataatattgtcttccaattcatgaacacaggatatattttcacttctttatgctgtctctaatatctttcagcaatgttttgtagttttcagtgtacaagtcttttacctccttagctgaatttattcctaagtattttattctttttgatgctattttaaatagaattattttttattttgttaatttcatctcagattgttcattgctagtgtgtagaaatacaactgatttttgcacgttgatcttatatcttgcaactttgctgaattcgtttattagctctatagtgttttgtggattcttcggggttttccatacataagctcatgttcatctgagaataagatagctttacttattccttttcaatttggatgccttttatttctttttttcctaattgctctggctaagacttccaatacaattttgaatagaagcagtaaaagcaggcattcttgtctcgtttctaatgttagggaaatatctttcagtcttctaccattgagtgtgatgttagttttgggtattttatgaatgctctttatcatgttgtggattttctcttccatttctagtttgcttagtggtttttttttttttttttttttttggtcatgaaaaggtgctcagctttatcaagtgatttttctgcatcaaccagaatgaacttgcaggggtttttttccctatattttattaatgtggagttgactgggggattgattgtcttatgttgaaccagtcttgcattattgggataatttccacttgagcatgggctataacctttataacatgctgctggatttggtttgctaatattttgttgaagatttttgcacctagatgcataagggaatattatactcacatattcaattacatgcaatttgtaattttcttttcttgtgatatatttgtctggctttgatatcaagatatggtggcctcatagtatgagttgtaaagtttactctccttttctgtctcttggaagagtttaagaaggattaatgttaatccttccttaaacatttagtagaatttaccagtgaggccttctagcacaatgcctggcacataatatatggaatctaggatttgtatagtcagtcattaactatttgttgaattaataaattgtctccccaagcaggtttctaatcaaggcacaaagattgagtaacgaatgaaggcaaagccaatgtatacagggtattagttttctaatgctggggtggcaaattaccacaaacttaatatggcttaaaacaacacaagtttattatcttacagttcgatagggcagaagactgacccaagtcttactgggctaaaatcaaggtgtcatcagggctgcatttctttctggaagctctagaaaaggatcctttttcggtcgcctgtagtcccagctactcgggaggctgaggcaggagaatggcgtgaacccgggaggcggagcttgcagtgagcggagatggcgccactgcactccagcctgggcgacagagtgagactccctctcaaaaaaaaagaaaaagaaaaggatcctttttcctttcttttccagcttctagaggccacacacattcattaactcatggcttccttcctccatcttcgaagccagtaacattgcacctttgtgactattcttaagtagtcacgtctccctttgactctcctcttctgcctctctctctcactttcaaggcctcttgtgattacattgggccgacctggataatccaggatattctccctattttgacatcagctaattggcaaacttaattccatctgcaaccttaaatccctcttgccatgcaacataacacagtcaaatgttctggggattaaaatgtggacatcactgagagatcatattcttcctagcacatacggtttagtcacaagttaatgatcaacatttattagctatataatactcttaagttcaacataaactttttggatgctgataaaacggaatggcattttacattgatatatacttcatttcaaaacttcttctacttctcaatgattattctgtagcaacaaatttcttttaaatcagaaatttggaaacataacgagacctatctcaaatcaaagatgactatccccttttggagtcagactacacattcattattttagtcaaaatgagacataaaattcaggcccccaagagctgccagtacccacttacgcaggaggtagctagacgaaacaggtagctttctacaaatgattttgcaccatcccaccccagagaggtggtttggagtgtttacttattacctgggatttaattatactagctcttgcaaaagccaaatctaaaggccataaatagaaggtcaaattttctcctatatagaaaggagagcagcagagaaaacaaaatccttggtaaatctttaaacaaagttatatggtttgaatatgttattcattctattttaaccccccaatacagatatatttataaaaaagaatattgtgatttctggtataacttgtttaggaacaaagccacaaatttattaatattttctattccctgggaagaaaaaaatgctacatggcagaataattttttaaaatttccagccgggcacggtggcttatgcctgtaatcccagcactttgggaggccgaggtgggcggatcacaaggtcaggagattgagaccatcctggctaacacggtgaaacaccgtctctactaaaaatacaaaacattagctgggtgtggtggtgggcgcctgtagtcccagctactcgggaggctgaggcaagagaatggcgtgaacccgggaggcggagcttgcagtgagccgagatcgcgccacggcactccagcctgggcgacagagcgagactccgtctcaaaaaaaaaaaaaaaaaaaaaattcccatgatactaaactgatgtgtgatcatataatagacttacactgatacctattttagtgtattcaagcagataaaaaatcccaggtgttctatgagtgatatcattttcagtatttcttatgctgtatgccatggtttaaatctaggcctttcgaattggcattactaccatatttctcaaactgtattccctttctcttgaatatgttatgtaattttgtccagaacccagacatgtcaaggtgtcaaatcccacgttttggatactaacgtgtctcattaattcatacagtgggatcattcattaatgcccacattatagactctctctctctctacacacacacacacacacacacacacacacacacacactacattcttagaagatcattctgagaccagggtggaggataggctgtgcattcccagtactctttcacagctgactgtgtcctctgccagtgttttcaaactttactgcttatgaaacagctaagggtcttattaaaatttagattctgattcagtagaactgacatggtgcccaaggaactgcatctcttttaaaaaatctttatttaggtataattgacaaaagttgcatatatttaagaggtacaacttgatgttttgatatattttgtttttcatatatgatgtttgatacattgtgaaatggtcaccacaagcaagctaattaagatatatctatctctttgcctagctacctttttttgtggtgagaacatttatgacctactcttttagcaaatttcaagtatacaatattgtttactatagttactatatcgtacattagatctccagaactaatttatcttgcataattgaaattttgtaccctttgatcaacatctccctgtttcccccacaccacagtccctagcacctaagattctactgtctgcttttatgagtttgaccatcttagattccacatatgaggtcatgaagtatttttctttcagtgtctggcttattacacttagcataatattttccaggttcatccatgttatcacaagtgggaggattttcttctattttaaggccaaataatattttataattgtgggaatattccatcagatatatatatatcagattgtctttatccctccatccatcaatggacacacttaggttgtttccatatcttgactattgtgaatactgttacagtgaacatgggagtgcagatattcaacatactgattttgtatcctttggatatataacagaagtgagattgccagatcacatggtattcatttttagtttttttgaggaacctctatgctgtttttcataatggctgtaccaatttatttttgcagcaacagtgtacaaaggtttccttttctccacattaccaccaacatttgtcatcttttgtctttttgataatagctatttgctatggtttgagtgttttccccaaaaaacatgtgttggaaacttaattcccaatgcgacagtgttgggaggtagggccgaatgggagatgtttaggttatgaggactccaccctcatgaatggattaatgccgattacaaaagcacctaaggctgtgaatttgaattgctctctcttgccctctttttgcccttctgccatgttatgatatagaaagaaggcctttgccagatgctggcctcttgatcttggactgcccagcctccagaactgtgagccaaatacatttctgttcactacaaattactcagtctgtggtattctgtcatagcagcataataaattagagtccataataagttatagtccataacagactaagacactattctaatagatgtgagggaatatctcattgtgttttgatttgcatttccctgtgggttagtgatgctgagcatcatttatctgttggccttttatatttcttcttttgaaaaattctatttgggttctttgcccatttttaattgggttgtttcttactaatgagttgtttgagtttcttacccattatcagatatacagtttgcaaatattttcatccattccataggttgtcttttcactctgttgattatttcttttgctgtgcagaaagtttttagtttaatgcaatcccagtttctatttttgtttttgttgcctgtgcttttggtgtcatataaaaaaattattgcccaaatcaatatcaggtagcttttttcctgttttcttctaggagttttatagtttcaggtcttatatacaagtgtttaatcaattttgagttgaattttatgtatagtgtgagaaaagggcccaatttctttcttctgcatgtggatattcagttttcccaatatcatttattgaagagactctcttttccccgttgtgtgttcttggcacccttgtcaaaaatctgttgactgtaaatgtgtgaacttatttctgggcttttctattctgttcccttggttgatgtgtctatttttatgccagtaccatactattttgattactggagacttgtagtatattttgaaatcaggaagtatgatgcctctagctttgttcttcttgcttaagattgctttgccaggctgcatgtggtggcccacgcctgtaatcccagcactttgggaggctgaggtgggtggatcacttgaggtcagaagtttaagagcagcctggccaacatggtgaaaccccgtctctactgaaaaaatacaaaaattagccaggtgtggtagcaggcccctgtgatcccagctaatctggaggctgaggtggagaatcacttaaacctgggaggcagaggttgtagtgagccaagatcgcaccactgcactccagcctgggcaacagagcaagactctgtctcaaaaaaaaaaaaaaaagattgctttgcctccttggggtcttttgtgatttcatattaattaaaattttttttttatttctgtgaagaacaccattgagattttgatagggatcacatcaaatctatagattactttgggtagtgtggacattttaacaatactaattcttccaatctaggaatatggaatatcttttatttatctgtgtcttctttaatttccttcataaatgttttctatattttcattgtacaagtctttcatttctttggttaagtctattcctaagtattttattcttttgttgctattgtaaataagattattttctaatttcctttgggatattttatagtgtatagaaacaccactgatttctgtatgttgattttgtatcctgcaactttacagaattcatgtattagttctaacaatttttttttgagtctttagagttttctacatgtatgatcatgtcatctgcaaaaagagataattttactattctcttctatttggatgctttttattttatttattttttaaattatattttaagttctgggttacatgagcagaacatgcagttttgttacataggtatacacgtgccctggtggtttgctgcacccatcaacccgtcacctacattaggtatttctcctaatgttatccctcccctagccccccaccccccaacaggccccagcgtgtgatgttccactccctgtttccatgtgttctcattgttcagctcccacttatgagtgagaacatgcagtgtttggttttctgatcttgtgatagtttttgagaatgatggtttccagcttcatccatgtccctgcaaaggacaggaactcatccttttttatggctgtatagtattccatggtgtatatgtgctacattttcttaatccagtctatcattgatggacatttgggttggttccaagtcttcgctattgtgaatagtgccacagtaaacatacatgtgcatgtgtctttattgtagaatgatttataatcctttgggtatatgcccagtagtgggatttgctgggtcaaatggtatttctagttctagatccttgaggaatcgccatactgtcttccacaatggttgaattaatttacactcccatcaacagtgtaaaagcgttcctatttttccacaacctctccagcatctgttgtttcctgactttttaatgatcaccgttctaactggcgtgagttggtatctcattgtggttttgatttgcatttctttaatgaccagtgatgatcagcattttttcaaatgtctgttggctgcataaatgtcttcttttgagaagtgtctgttcatatcctttgcccattttttgatggggttgtttgtttttttcttgtaaatttgtttaagttctttgtagattctggatattagccctttctcagatggatagattgcaaaaattttctcccatcctgtaggttgcctgctcaccctgatgatagtttcttttgctgtgcagaagctctttagtttaattagatctcctttgtcaattttggcttttgttgccattgcttttggtgttttagacatgaagtctttgcccatgcctatctcctgaatggtattgcccaggttttcttctaggatttttatggtcctaggtcttacgtttaagtatttgatccatcttgagttgatttttgtaaaaggtgtaaggaagggatccagtttcagttttctgcatatggctagccagttttcccaacaccatttattaaatagggaatcttttccccattgcttgtttgtgtcaggtttgtcaaagatcatatggttgtaactgtgtggtgttatttctgaggcctccattctgttccattggtctgcatatctgtttggccccagtaccatgctgttttggttactgtagccttgtagtatagtttcaagtcaggtagcatgatgcctccagctttgtccttcttgtccaggattgtcttggctatgagggctctttgttggttccatatgaagtttaaagtagtgttttccaattctgtgaagaaagtcagtggtagcttgatggagatggcattgaatctataaattactttgggcagtatggccattttcatgataatgattcttcctatccatgagcatggaatgtttttccatttgtttgtgtcctctcttatttccttgatcagtggtttatagttttccttgaagaggtccttcacatctcttataagttgtattcgtaggtattttattttcttagtagcaattgtgaatgggagttcactcatgatttggctctctgtttgtctgttattggtgtataggaatgcttgtgatttttgtacattgattttgtaccctgagactttactgaagttgcttatcagcttaaggaggttttgggctgagatgatggggttttctaaatatacaatcatgtcatctgcaaagagagacaatttgacttcctcttttcctatttgaataccctttattgctttctcttgcctgattgccctggccagaacttccaatactatgttgaataggagtggtgagagagggcatccctgtcttgtgccagttttcaaagggaatgcttccagtttttgcccattcagtatgatattggctgtgcgtttgtcataaatagctcttattattttgagatatgttccaccgatacatagtttattgagagtttttagcatgaaggggtgttgaattttatcgaaggccttttctgcatctattgagataatcatgtggtttttgtcattggttctgtttatgtgatggattatgtttattgatttgcatatgttgaaccagccttgcatcccagggatgaagccaacttgattgtggtagataagctttttgatgtgctgctggatttggtttgccagtgttttattgaggatttttgtatcgatgttcatcagggatattggcctgaaattttctttttttgttgtgtctctgtcaggttttggtatcaggatgatgctggcttcataaaatgagttagggaggattccctctttttctattgtttggaatagtttcagaaggaatggtaccagctcctctttgtgcctctggtagaatttgtctgtgaatccgtctggtcctgtactttttttggttggtaggctattaattactgcctcaatttcagaacttgttataggtctattcagggattcaacttcttcctggcttagacttgggagggtgtatgtgtccaggaatttatctatttcttctagattttctagtttatctgcatagacgtgtttatagtattctctgatggtagtttgtatttctgtgggatcagtggtgatatccccaatatcattttttattgcatctatttgattcttctctcttttcctctttattagtgtggctagaagtctatctattttgttgattttttcaaaaaaaccagctcctggattcaatgattttttgaaggtttttttgtgtctctatctccttcagttctgctctgatcttagttatttcctgtcttctgctagcttttgaatttgtttgctgttgcttctctaattctttaattttgatgttagggtgtcaattttcaatttttcttgctttctcttgtgggcatttagtgctgtaaatttccctctaaacactgctttaagtgtgtcccagaaattctggtacgctgtgtcttcattctcattggtttcaaagaacatctttatatctgccttcatttcattatttacccagtagtcattcaggagcaggttgttcagtttccatgtatttttgtggttttgagtgtgtttcttaatcctgagttctaatttgattgcactgtggtctgagagactgtttgttatgatttccattcttttgtatttgctgaggagtgttttacttcgaattatgtaatcagttttagaataagtgtaatgtggtgctgagaagaatgtataatctgttgatttggggtggagagttctgtagatctctattaggtctgcttggtccagagctgagttcaagtcctgaatatccttgttaattttctgtctcattaatctaatattgacagtggggtgttaaagtatcccactattattgtgtgggagtctacgtctctttgtatgtctctaagaacttgctttatgaatctgggtgctcctgtattgggtgcatatgtatttaggatagttagctcttcttgctgcatttttccctttaccattatgtgatgctcttctttgtctcttttggtctttgttggtttaaagtctgttttatcagagattaggattgcaactcttgcttttttttttgctttccatttgcttggtaaatattcctccatccctttattttgagcctatgtgtgtctttgcaagtgagatgagtctcctgaatacagcatactgatgggtcttgactctttatccaatttgccagtctgtgtcttttaattggggtatttagcccatttacatttaaggttaatattgttatgtgtgaatttgatcctgtcattatgatgctagctggttgttttgcccattagttaatgcagtttcttcatagtgtcaatgttctttacaatttggtatgtttttgcagtggctagtaccagttgttcctttccatgtttagtgcttctttcaggagctcttgtaaggcaggtctgatggtgacaaaatccctcagcattcggttgtctgtaaagaatttcatttctccttcacttatgaagctttaagaggtttaattgactcacagttctgcatggctgtcccataagtcccatgttctttcctcaggaaacctacagtcatagcagaaagggaaataggcacatcttacatggcagcaggcaagagagagtgtgtgaaggaggaactgtcaaacacttataaaaccatcagctctcataagaactcactatcaggagaacagcgtgggggaaaccatccccatgatccaatcacctcccactaggtccctcccttgacatgtgggcattatggggattacgattcaaggtgagatttgagtgggaacatagagccaaaccatatcagtatctaaaaggaaaaaccttcagtttttccacatttggttatgatatcagctgtgagcttttcctatatggtctttattgtgttaagttccttctgtatctatcttgctgaaagtttttattatgaatggatatctagttttgtcaaattctttttctgtattgatcgaaataatcatgtgtttttcatctttcattctgataatgtggtatatcacattgattgatttgcccatgttgaaccatccttgcatcctagggataaataccacttgttcatgatgaatgatccttttaatgtgctgttgaatttggttggctggtgttttgttgaggatttttgtatccgtgttcatcagggatattggcctgtagttttctttcttttcttttcattttctttttctttctttttttttttttttttttttgagacagagtcttgctctgtcacccaggctggagtgcagtggtggtatgatcttggctcactacaacctccacctcctggattcaagcgattctcctgcctcagcctcctgagtagctgggactactggaacatgccatcacacccagctaatttttgtatttttttagtagagatgagttttcaccttgttggccaggctggtctcgaattcctgacctcaagtgatttgcctgcttcagcctcccaaagtgttgggattacaggcttgagccaccacacctggcctggcctgtagttttcttttctagtgttgtttttgcctggatatggtatcagggtgatgttggctaataaattgtattttgaagtgttctctcttgtattttttggaagagtttaagaaatactggtattaatacttcgttgaatgtttgatggaattcatccatgaagccattggtcctgggcttttctttgttggaaggtttttgattactagatttaatatccctatttgttgttagtctgttaaggctttctatttctttgttattcagttttggtatgttatatgtttctaggaatttatccatttcctctaggttaaccaatttgttgacacttataatagtcccttatggttctgtctgtttctgtgacatcagttgtagtgtctcctctttcatttatattttatttatatgagtcttctctctttttttcgtagtctagataaggacttgtcaattttgtttattttttcaaaaaaatcaactcttagttttgtcagttatttccaattgtttttttattctcttttttatttatttctgctctagcatttattatctcctttgttctgctacctttgggcttagttttttttttcttctttttgtagttcctggaggtgataagttgggttgtttatttcatatgtttcttctttttaaatataggcatttattgctataaatttccctattagtatgcttttactgcatcctttaagttttggtatattatcaagattttggtttcttctgtgacccaatggtcgttcaagaatgtgttgtttagtttccacatatttgtgaattttcgtgttttcttattgttattgatttgtagtttcaatccattgtggtcagaaaatatacttggtatgatattaatcttcttaaatttattatgacttgttttgtgacctgaaaggtgatctgtcctgaagaatgttttgtgtgtgcttgataattctactgttgggtggaaagttctgtatatacattttaggtccattgggtctattttattcttcagttctgttttgtccttattgattttctgttgggatgatctattcattatagagagtggagtattgaagtcaactatattatattgttatctatttctccttccatgtctgtcaatgtttgctttatatatttaggtactttcgtgttgggtacatatatatttataattattacatcttcctgttcaagtgacccttttattatataatgaccttctatgtctcatgtcacagttttttacttaaagactattttttctcatacaagtatagccacccctgctctcttttggttacagtttgcatggcataactttctccaccccttcactttcagcctatgtatgtccttaaatcaaaagtgagtctgttatcaacaacatgtagttgggtcctgtttatttttgtttcttacttcccatctctgaattgttggctttttaaaaagcccattcagttactctgtgtcttttgactggggagtttagtcaatttacacttaaagtaattattgataggttaggactttctgttgccattctgttaatagttttctgttttgtagttttcttgttcctttcctctttttctttctttgtggtttgatgatttttgcttggatgtgttttgattcttttctctttatcttctgtatatctactgtgtgggggggcggtcgggggggttaccacagggatcaaattgaacactttatagttatggcagtctgttttaagctgacaacaccttcaatcacatacagaaactctatactttactcattccccccgccacaactttatgtaatcgacgtcatattttacttccttctatattgtgtttccattgacaaatttctgtcactatagttactattactatttttgtcttttaatttataaattaatattaatagtgatttataacaatcattatagtgttacaatagtctatgtttctctttatatttacctttagcagtgaaaggattcatatgcttttgtgttactgttttttttttatttcaacttgaagaactattagcacttcttataaggcaggtctcatggtgacaaaccccctcagtttttgtttgagaaaggctttatctttgtgttcattcttaaaggacagtttttccagataaagtattgttgattggatttttttctctcagtactttgaatatatcatcccactctttcctgacctgcaaggtttctgctgagatatccactcatagtcttatggagctcccctataggtgacaattcactttcttcttactaccccaaaattctcttttgtctttgttgaaaatttaattataatgcatctcactgtagacttctgtgggtttaatgtatttggttatctttgggcttaatgaatccagatggcacttcccctccatagatttggggagttctcacctattatttctttaaataagtttcctttctctctctcttctccttttaagatttctataatgcatctatcattttgcttgatgatgtcccataagtcctctgttcttccttcactctttctcattgttctttttattccgctaactagataatttcaaatgacttgtcttcaagtttacaaattctttcttctgaatgattgagtctgctattaaagatcgctattaaattttttagttcagtcattcttcagctatattcagcaatattctttagctacaggatttttatttggttcttttttatggtttttatttctttattaaacttctaatgttgttcatgtattgttttcctcattttgttagtcgtcttcctgtatcctcttgtagctaattgagcttctttaaatgattattttgaattctttgtcaaaaatttcatgaatctccatttcttcagggttggttactggagctttattagttccctttggtgatgtcatatttgcctgattcttcatgatccacatagcctagcattggtatctgtgcattggagtgagctgacacctcttctggtctgaagttgggtactcagacaatgggcccattaccagggctttggataggtgtagctctcactgggtccttgagtgggcaggactgcctgcagaccatgatgcagtgggcctggagctgggtcaaagggctgcttcagggtccccacttgggcccacagtcagtgggcctgttatgggggcacaggtaagtgtggattcaggcaggactgtctccagaacatggtacagcaagactggagttggctcacagggttacttctgagtccacagtcaggtctagttggtgggcctgcttccagaggtggactggcatgactcccacctgtttcctaagtaggcaaaacttccccaagaccatggtagtgtggtactgaagctgctttaggtacagggctgcttcagagtccacagttgggagccctgttactggggttgccaatgggagttgctcctcccagattcctgggcagatagggatagtggtaggaccacatacaaacaactctggagctaagtccccagggtggtgggctgcttctgggtccacaaccagaactacagttgacaggcctgccgctagaatgtgggcctgccttattaaagtattcatctttgttcttgagctctaccagggtttctcaacctcctacctgaatcccaaggctcccacaaagacacttttgtccatagatcattgtcaaattattgttcctgtgggggaacaagagctagggacctcctatcccatcaactcactgataccgttctcctgatgctgcattttgaattgccctcaggtgatgctgctactcctggtctgtggaccatgctggagtagcagagcccaaatggcttcctcaacttttatgagccttttacaggaactcaaagtagaaaataacttcacttgccccagacctaataatttcctttgttcccacttcttcttggtgctttcctcctttgtgtctaccatcgtaacatccatctaaccatagttgtcttatgtagatgttggatgctgttgagaaacgcacaaagcaaattagaaggaagatatgattgacagaaattgctttttactctgtattcactttccatgtatttgtgctaatctctccatacaggtcttctttggcaatgtggattcatctgggataaaacacaatatttttaaccctccaattattgctcgatacatccgtttgcacccaactcattatagcattcgcagcactcttcgcatggagttgatgggctgtgatttaaatagtaagtgccaagtcatcccatatccttcttccctcaaccatgggtagggtgactaactgttctagttatcctgagactgggggaggggttcccggtatcaggacacaaaattgtcagtgctaaaaccagcatagtcctgggcaaacccagaaataccattcaacccagcagtcccatcactgggtatataatcaaaggaatataaatcattctgtcataaagacacatgcacgcatatgttcatttcagcactattcacaatagcaaaggcatggagtcaacctaaatgcccatcaacaacagattggataaagaaaatgtggtacatacataccatggaatactatgcagccataaaaaagaatgagatcatgtccttttcagcaacatagatgcagctagaggccattatcataaatgaactaatgcaggaacagaaaaccaaatatcatgtgttctcataagtgggagctaaacattaaatgcacatggacacaatgatggacactcaggaggggagaggttgggaggggggtgtgggttagaaggttatgtattgtgtactgcactcactacctgagtgaggggatcattcatacaccaagcctcagtgacatgcaatttacccatgcaacaaacctacccatgtacccctagaatctaaaataaaagtagaagaagaaaagaaacaaagaaaattaaagagtcacacaaagtgggaagagctggctggaaaacagatagcaataacagaattggccgggcgtggtggctcacacctgtaatcccagcactttgtgaggccaaggcgggtggatcacgaggtcaggagatcaagaccatcctggctaacatagtgaaaccccaactctactaaaaatacaaaaaattagccgggtgtggtggtgtgcgcctgtagtcccagctactcgggaggctgaggcaagagaatcgcttgaactcgggaggcagaggttgcagtgagctgagatcatgccactacactccagcctgggtgacaaagcgagactccatctcaaaaaaacaaaaacaaaacaaaacaaaacaaaaaaccaataacagaatctgtgcaaaagttaaaacctgagaaatgatattatgatgacagtagccctagaatatcagtggaagctgctcagtataactgaggctgaagcatgtccttgtgataaccttcttttttcttttctttgaggttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtaagaggcaacagatttactgtttaactgactcagagcagtggttggggaaaaaatcggggaaggccttgactgtttcttctgaggtatttctgtcaactgttagttctaaaaagtgtgtcaaggaagtttggttatgggcagacaaccacacaggcatttgggggaaatgatctctaattgaacctcctggaagaagaatctctatatctagtactgagctaatatctgtcaaagaattgtagaagctaaagtccattttacagataaatatcaacaattagctttctttccaggtttctcattacatcaatgaaaagtaaacatttactgcacatcttagtatccctaggatgagcctagggatacaaaggtgaattgtgaaaaattttggccctgaagttgcttagagttgaataagagagactgactagccaatagaaagtggaggctgggtgcggtggctcatgcctgtaatcccagcactttgggaggctgaggcgggccgatcacaaggtcaggagttctagatcactcttttgctgaggcaggataatcgcatgaacctgggaggcggaggttgcagtgagctgagatcatgctattgcactccagcccaggcaacagtgcctgactctgtctgaaagaggcagagagagagagagagagaaagaaaggaaagaaggaaggaagaaaaagaaagaaaggaaggaaggaaggaggccgggcagagtggctcacgcctgtaatcctagcactttgggaggcctaggtggcagatcacctgaagtcaggagttcaagaccagcctggccaacctggtgaaacctcatctctactaaaaatataaaattatctggacatggtggtgggcacctgtaaccacagctactcgggaagctgaggcaggagaatcggttgaactcgggaggcagaggttcagtgagctgagatcatgccattgcactacagcctgggtgacagagcaagactccgtctcaaaaaagaaagtagagtgagaagtgctgtggtatggttaagagggatttgggaatttctgggagtaaatggtgaccaagaggctactagtccaactctattgccctcaggtgaataatccaaaagagtggctgcaagtggacttccagaagacagtgaaagtcacaggagtaactactcagggagtaaaatctctgcttaccagcatgtatgtgaaggagttcctcatctccagcagtcaagatggccatcagtggactctcttttttcagaatggcaaagtaaaggtaagctggtctccttggaaagaaagaaagaaagaaaaaaaataccacctctcctagagcttaacataacataaaaaggttgatatatgaccaaattttcagagcaaaatttattaagtacctatggtagcaagacattgtaaaaggcattctgagagaacacagtgactttaagaaaaaggtaaaatactgagaaaagggcagagtagatccaagagttaattctcctcatcagcaccttgattcccaagcctttttgacctttaagtttagtggtccaggaagtcttcattcttaatctgggtttgctggataattcaacaaattgtcctgattaaaagacatgacataaagtcttatcaccccatgagtaatgggggaaggaatagttcctctctttggtattttttatattcttttttcaccaagaattaaccatgatgtggtccttaccaatctctctaatacagtctcttgccacttggctctttaagctccatccatactaagaaattctcaggtcactaaatacagccattatatctcataccaggcttttaaatagatactatttcttctacctggaacatttttctagctaccctctactgccactttcacctgactcattcgttaagtctcaggtaaacatcatgtccaagaagaattcccttatccatcaaggctggatgaaagacttcaccaaactggcagtttggtgaactgaagtctagacattggatattctagaagaaaaattcccatttaaaaaaggttatatctctgattagtgccacaacatgatgaactttcaaaatatgctaagtgaaggccgggcgcggtggctgatgcctgtaatcccagcactttgggaggctgaggcaggcagatcacgaggtcggtaaattgagaccatcctggctaacacagtgaaaccccatctctactaaaaatacaaaaaattagccaagcgtggtggcgggtgcctgtagtcccagctactcgggaggctgagacaggagaatggcatgaacccgggaggcagagcttgcagtgagccgagatcgcaccactgcattccaacctgggcaacagagtgagactccatctcaaaaaaaaaaaaaaaagaaaatacgctaagtgaataggccagacataaaaggatagatattatatgattctacttatatgagtgtgttagtcagggatatccaaagaaatagaaccaataggagattctgtctgtctgtctctctctctctgtctctctggatgagctaaactgttttagttcaagactgaaagcaggaaaaagctgatgttccagtccaaaggcagacaggcagcaagaatactttcttacttggggaagactcagtctttttgttctattcaggccttcaactaattggatgatgcctcccacattagggagagcaatctgctttactcagtctactgacttcgatgttaatcccattcaaaaacaccttcacagaaataaccagaataatgtttgagtaaatatctgggcaccttatgaccaagtaaagtagatacataaaattaaccatgacaagtccaccccttgtcaatgtagcacccatcatacacatctcctttatctctaagtagagacaaaaatgaggtcataattccacctaacatgatataacaaaacttggctggtattgataactaccttcttctactacccattctgtattgactttgccttcagcaagcatctcagctgattgtggttctttacctgatgaggtgacccaaacctttattcctgaagagcctgggccactagtagtcctgcatggattgggttgctgtagtttcccattgaccagaatcatagggcctggtaatactaagagacactctaagggatctattgtattccagacacactcttccatacctccattgtgaagcagtagttcagtttccttccaggaaggacaaaacgctgccccttccatgatgaacatattccaatgtaatcaacctgctgccagatagctggctgatcatcctgggaaatactgccatactgaggactctgtgtttgtctctactgctggcagattgggcacttagcagtggccatagccaggtcagccttgttgaatagaagtccatgttgctgagcccatgcatagcctctatccctgccaccatggctactttgttcatgagcccatcaggcagtgacataggtggctgagtaaaaaggatgactggtatccacagaacaggtcatcatatctactttttttttgagatggagtcttgctctgttgcccaggctggagtgcagtggcacaatctcagctcactgcaacctctgcctcccaggttcaagcatttctcgtgcctcagcctcccgagtagctgggactacaggcacgcatcaccatgcctggctaatttttgtatttttagtagagacagggtttcaccatgttggccaggctggtcttgaactcctgacttcaggtgatcctcccgccttggcttcccaaagtgctgggattacaggcgtgagccactgcacccggcccatcatatttacttgattattgaaatccttatctgctgaggtcacccttcgttgagcactcacatgggacataaatatattcacatcctttgcccattcagagagatctgtccacatacctcttccccaaatttctttgtcacctgttttctaatcatgttccttccaagtccctatctggacaaagcactgactacagcccattacttgacatataattgcacacctggccatttctccttctaagcaaagtccacaaccaggtacactgcctaaaattctgcccactgtccttcatgggtatctcagatcgggactgtccacttttgtgtagtacctgcatatcgtgcagaaccgtctgtaaaccaggcccaagactcctcttcctctgtaaactgatcatagggaactcccaatggggccataagtgcaggctgggagagagaaggcagggtagcagaaacaggcaccatggacatttgggctacttcttcatgtaatttacatgtgttttcagtacctgctcagacatgatcatgtatataccacttccatttgatgatggagtgccattgttcatacccaactttatggcttggtgggtcagataacacctagttcatgatgggcagttcaggtcacatggcaacttggtggtctgtggctaagcattcagtatctactaaggcccagtagtaggccaagagctatctcacaaaaggagaacagttattcacagaggattacaggaggatttctcactacagtagcccctgctccataggtcagggaaccaatgtgaagatcctgctagctgctcaatatatctgttccaattacgcattccaggactggggaaataaccacaagatagtctcacagatcctctgcatccactttgagatggacttgagctaaaattccattgatcatttgaccctccataagcccatactctgactggtggaccacagtgacattttgggtctcctgaaattagtgccagttcagagccattgtccagtagtccctgaaaggtctgattaattatttttcttcagtgcacatttattctgatagaaaggccatatgtccctttggggaaggctgagagaaagagtggcagtattcttggcagtgtaccagagtccttcctcaaggagactgagcctccccttcattcaaggagtgctgggtctgtaaacctgctcaagtctgggaattgattgagaggccgtgactctgtttttattattcaggttagacttttgttcacttgacctagaacttttccacttatgcagttcaagaatttggtaggcattctatctatatcacatctaggaacactataatctactagccaacaccataggtctgtgcaagtcatactattctaactgctgctttgactctgctgtcccttatggtaaccacacttaccttgcctttggcagttgagtgctgcccattggccccttccaccccaggatccaattattcccattgtatttaggttttctaattcagtgactgcaggtcctgctgtaaggtgtcacctacagagaagagtgatcacagagcccttcaaggatgctgaggttcccctcacaaatttattcctcaaagtaatagtgagatctgtgtcttctgaactctcccagtgttggtgagtatgtcttaaatgacaaattcactctagcatttcaatctcctttcttctacattaaaccagggcaagtctgaaatttctagtttgctcactgtgggccatcttttggtctgtgtttcagccaaccaattaaactgttagaggccttcctaattccctgagatgcaacattaagtccagaatctctgcttagtgggcccatgtcaataaatttggcctaatccaactttacgtgccttccaccgttatctcacatccttagtacccattcctatacatattctctggattcctgcttgtgtaaattagaaaactcaagtcatgattttggagtgtagtgcaccttgtcatgggtcaccttcatacctcacctcgcctgctgggacttgagtgtagttatagatctaataacaaagaggggtggtagggtgggtcctgaaggaatcagcattatcttgcatggcagttgcctcaggggaagccattacagtttcctcaggcagtgcagggttaatccacttagactggagtagagatactgccaccacagggctggagagaaaactttcactgacaaagaagactcatcaatatttaggagctcaatgtccccagcttaatcagggtcttccacacatacctaatccaacttgtagtgccccattctttcccaatcactgcccttgctttaacagtagacaccctgcaaagctgggagtttggcttgctttgtaattcagttagtcacaggatgagatttggcatttgattttcagcaatctcagctctgtggctacagtagataagggtctccttcagggcatacatagaatctgtcaagtcatttatgcagctcttgagctgggaattcaaattcctgagctcctccttttctttcatcactttttccagcaacattaggagcaaccgactaatcccatcatattcattagtttgacaaatatgttcacaagtgtcaatatacatagtcaccaagacccttgcttcttaaaagtagttgattaggagtatccaatggagatattttgcatatacatattttttgagatggagtctcgctctgtcacccaggccggagtgcagtggcatgatctcagctcactgcaacctccatctcccaggttcaagcgattatcatgcctcagcctcccgagtagttgggattacaggcacctgcctaatttttgtgtttttagtagagacagggtttcatcatgttggccaggctggtctcgaactcctgacctcaggtgatccatccacctcggcctcccaaagtgctgggattacaggcgtgagccaccgcgcccagcctggcctacatatttctattgccagatcatgccatggacaatttttactactgaaaatagtcattagtgtctttaaatttcatcaggttacagaaccaattccagaaatccaataacaaatttataaaatttatccttaaaattctgttcctttagaatcactcttggtgtgaaaatctgtattagtcatggttcccaaagaaacaaaaccagaaccaagaggagatacatacacacacacacacacacacacacacacaaggaattagctcatgtgattatggagtctgccaagtctcaagatctgcagggtgagttggcagcctagagaccccagagagctgattcgtagttccagttcaaagaccagcaggctacagacccagaaagagttaaaatgttttagttcgagcccaaaggcaggaaaaaaactgaagtcccagtttaaaggtagtcaaatagaaggaactgtctcttactaagaggacagtaagcctttttgttatatttaggccttcaactgattggataagttctacccacactggggagaacaatctgctttacttagtctaccaattcaaatgttaatctcaccaaaaaacactctcacagacacacataaaataaagtttaatcaaatatatgggcaccccatggcccagtcaagttgacacataaaattaaccaccataatgaggtatctagagcaggcaaattcataaagacagaaagtagaaaagaggttaccagggtcttggaatggggaagaaatggagagttatttttaatgagtacagagtttctgtttggggtgatgaaaaagttctggaaatggatagtggtaatgggtgcacaatattgtgagtatacttaataccactaaattgtacacttaaaaatgattaaaatggtaaattttatgtatattgtacaacaataaaaaaggctatatcactgacaatgcattgttgtatttagcaaagaaaggggaatctccagcctccccatcaacaaaaacccccacaaacttctattttaaaataatgagctgaaatcatagcggagaggtgaataatgagcaaatataaaaaggaagacctttcctcagacagaatgcccatattaatgttgttactggaagactaagccttgagcaaaatgcaaggagaactcagtgtgagaattctgcattgtcatgaatcccagaaggaagctagagaagttgcagataaatattatcctctggcacctggaagaaccattctcaacctactctagaaaaaaagcacctccagtttaggcctccaggattcctacatattaaaattataagatcacagacatagatcagcaaacatgcaagacaacaagacaacttgagtacaagtgaacagaaacaatcaattcagatttaaaacttgaagaacaccagatattgacattatcggatacataatatgaaataattatgtataaaatctttaaagtaataacatatggaaacatgaaaataaaagacaaattatccaacattattaggcagttgaaaaaaaccattgcaggttacaaagtcaacatgcaaaaatcaattgtatttttatatactaacaattacaaatatgaaaaggaaaacagaaaagtctatttacaatagcatcaaagataatacaatatttaggaataaatttaacgaaggaggtgcaagtcttgtccactaaaaacaaaaaaacccagttgaaagaaactaaagaactgtctggtctgaagacagcaaatatggaaaattagcaactagaaaaaaattaaaaattaaaaattaaaagagaaattaaataactaaataaatgaaaaggcatcctggatttatggatttgaagacataatattcttaagataagaatattaccacaaaccatttgcagattcaaagcaagcattctgggtttttttgtttgtttgtttgttttttgatttgagacggagtctcactctgtcgctcaggctgcagtgtggtggtgcaatctccactcaccataacctctgcttcctgggctcaagcgattctccggcctcaaagcattctctatcagaatcccaaagacatttttttttttgaggaatagaaaaatctatcctaaaattcagatggaatttcaagggaccctgaatagccaaaacaatcttgaaaaagaacaacgttggaggagtcatacttcccaatttcagaacttactacaaagctacaagaatcaaaacagggcagtacttacataaatatagacacatagatcaatggaatagaattgagagtccagaaataagcctatacatctatggtcaattgattttcaataaaagtgccaagaccattttgtgggaaaagaatagtctcttcaacaaatggtgctgggacaattggatatccacatgcaaaagaatgaagttggatctttaccatatacaaaatttaactcaaggctggatgtggtggctcacatctgtaatcccagcactttgggaggctaaggctggtggatcacttgagctcaggagtttgagaccagcctgggcaacacagtgagactctgtatctacaaaacaagaaaaaaaaattagctggcatgatggtacacacctgtagtcccagctactagggaagctgggataggaggatcgcttgagcccaggaggtggaggctgcagtgagccatgatcgcaccactgcactccagcctgggtgtcagagcaagaccctgtctgtaaaaaatcatttaactaaaaatgtatcaaaaaactaaatataaaagctaaaaccataaaactgtaagaaaaaacaaagaggtaaattgttatgatactggatttggcaatggtttcttagatgtgacaccacaatcacaagcaacaactctataaaaatatatatagtaggcatctttaaagttaaaagcttttgtacatcaaagaacactatcaagaaagtaaaaagatgatctacagtataggagaaaaaaattgcaaatcatatatctgataaagggcctagtatcccagaatataaaaagaactcttacaactcaacaacagaaagacaaccaaattttaaaatgggtaaaggacttcaatggaacttctccaaagaagatatacaaggatccaacaaactcatgaaaagatagacaacatcattagttattagggaaatgcaaatcaaaaccacaatgagatagcatttcaaacctgctaggatggctaaattaaaaaaaaaacaaaaacaaaatgtcaagcgggaaaataacaagtgttagcaagaatataaagaaattggaaccttccttgatgatgagaatgtgaaatagggcagccactgtagaaaatattttggcagttcctcagtaaggaaaacatagaattaacatagacccagcaattctactcctgggtgtggacccaaaagaattaaaagcaggcactctaacaaaaactaatatacaaatgcatatagaagtactattcataatagcaaacaggtgaaaacaattcaaatgttcatcaagtgatgaacagataaacaaaatgtggtctatccatatatggactattatttattcataaaaaatcaaagtactgatccatgctaaaacatggatgctccttgaaagcattatgctaagtgaaagcagccaggcacaaaaggccacattccacttatatgaaatacccagaatagcaaatccatagagacagaaaacagattagtggttgccagaagctggcagaaggagtgaatgtggagtggcttcttaataagtattgaatctccttttggggttatagaaatgttctggaactagatagtggtgatggctatataacattgtgaatgtactaaatggcactgaacttcacactttaaaattgttaaaatggtaaattttatgtttgcgaattttgcaatagataagtcagaagacatgtacattaccataatgagtaacaaactgacagctgatttctaaataatagcaaatatcagaaaataatgaatgatgtcttcacaatgctaaaataaacaatgtgaacccctctctcaaaaagaaaacctaatgaaaatatcttttatgcgttaaagcaaaagaggaaattaggacacagacaggcacagagggacgaccacatgaagatatagaaagaggacagacacctacaagccaacgagagaggccttacaagaaaccaacccttagccaggtgtggtagtgtgcacttgtagttcttgttacaagggtgcagtgagctagggttgtgccactgcactccagcctgggaaacagaacaagaccctgcctctaaaaaaaaaaataaagagaaggagaagaagaagaaaaggaaaagaaaaaaaaaaagaaccaagcctgctggccaggcgtggtaactcatgcctgtaatcccagcactttggaaggctgaggcaggaagatcatctgaggtcaggagttcaagaccagcctgcccaacatggtgaaacccccctctactaaaaatacaaaaattagctggacatgctggcatgcgcttgtaatcccagctactcgggaggctgaggcacaagaattgcttgagcccaggaggcagaagttgcagtgagcccagatcgcgccatcacattccagcctggactacagagggagactccatctcaaaaaacaaacagacaaaaaaaaaatacacacacacacacacacacacacacacacacacacaaaacaagcctgcctaccccttgatcttggacttgtagcctccagaactgtgagaaaataaatttctattgtttaagccaggtgtgcgtgtgaaaatttagaacatatgacaacagcaaaaaagtcagcatgtggataaatagaataaaggattctaaaatccatgtattatctaggaggtaaagatgttaatattaaaccttcataatttgattaatgttgtagtttataggatagccagtaagtaatagaaatacacacaatgtaagactcccaaaatggtagaagaaaaaatatgaaaggataaaatatactcaacaaacctaaatgaaagcaagcaaagagagataaagaaacataaaacaggtaggaaaaatagcaagataagatggtatatttaaattgaaatataacagtaatcatatgtaatatgaatggaccaaatatttcagttaaaagacaaagattgtcagattgataaaaaagcaaaagtagctgggtgtgatggctcacacctgtagtcccagctacttaggatgctgatgtgggaggatcacttgagcccaggaggttcagcctggacaagatagtgagacttgtctctttaaaaaaaaaaaaaaaaagcaaaagtaaattgtgtgcattttatgagtcatatctaaaacattagatacagaaaagtagcaagacaaaaatgggaaaagaaattatgcaaatatctaaaagatatcgattacagctctattgatagcagaaaaatagactttaaagcaagaaagtattgctgaagattaagaatgtgatttcatggctggacgcggtggctcacacctgtaatcccagcactttgggaggccgaggcaggtggatcatgaggtcaggaaattgagaccatcctggctaacatggtgaaaccccgtctctactaaaaaaaaatacaaaaattagccgggtgtggtggcggacacctgtagtcccagttactcaggagggtgaggcaggagaatggcgtgaactcgggaggctagattttaacacatctctcgtcaattgatggaacaatgtatagaaatagaacaattaacatgattcacaagtttgatcttatagacatatttagaaaatagcaccttgaaattgcaaaattacaagggtggttccaacatggccgaataggaacagctccagtctacagctcccagcatgaatgacacagaagacaggtgatttctgcatttccaactaaggtaccaggttaatctcactgtggcttgtcggacagtgggtgcaggacagtgggtgcagcccaccgagcatgagccgaagcagggtaaggtatcacctcacccgggaagcacaaggggtcagggaattccctttcctagccaagggaagctgtgacagatggcacctggaaaattgggtcactcccatcctaatactgcgcttttccaatggtcttagcaaacggcacaccaggagattatatcctgcacctggctcagagggtcccacacccacggagcctcgctcattgctagcacagcagtctgagatcaaactgcaaggtggctgcaaggcagggagaggggcacccgccattgctgaggcttgagtaggtaaacaaagcggccaggaagctcgaacttggtggagcccaccgcagctcaaggaggcctgcctgcctctgtacgctccacctttgggggcagggcaaagacaaacaaaaagacagcagtaacctctgcagacttaaatgtccctgtctgacagctttgaagagagtagtggttctcccagcacagagtttgtgatctgagaacggacagactgcctcctcaagtgggtccctgacccccgagtagcctaactgggaggcacgccccagtaggggcagactgacacctcacacagctgggtacccctctgagaccaagcttccagaggaacgatcaggcagcaacatttgctgttcagcaatattcgctcttctgcagcctctgctgctgatacccaggcaaacagggtctggagcggacctccagcaaactccaacagacctgcagctgagggtcctgtctgttagaaggaaaactaacaaacagaaaggacatccacaccaaaaccccatctgtacatcaccatcatcaaagaccaaaggtagataaaaccacaaagatggggaaaaaacagagcagaaaagctgaaaattctaaaaatcagagtacctctcctactccaaaggaacgcagctcctcgccagcaacggaacaaagctggacagaaaatgactttgacgagttgagagaagaaggcttcagatgatcaaacttctctgagctaaaggaggaagttcgaacccatcacaaagaagctaaaaaccttgaaaaaaaaggttagatgaatggctaactagaataaccagtatagagaagtccttaaatgacctgatggagctgaaaaccatggcacgagaactatgtgacgaatgcataagctttagtagccgatgcgatcaactggaagaaagggtatcagtgattgaagatcaaatgaatgaaatgaagcgagaagagaagtttagagaaaaaagaataaaaagaaatgaacaaagcctccaagaaatatgggactatgtgaaaagaccaaatctatgtctgattagtgtacctgaaagtgacagggagaatggaaccaagttggaaaacactctgcaggatattatccaggagaacttccccaacctagcaaggcaggccaacattcaaattcaggaaatacagagaacgccacaaagatactccttgagaagagcaactccaagacacataactgtcagattcaccaaagttgaaatgaaggaaaaaatgttaagggcagccagacagaaagttcgggttacccgcaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcttgccctacaagagctcctgaaggaagcactaaacatagaaaggaacaaccggtaccagccactgcaaaaacatcccaaattgtaaagaccatcgatgctaggaagaaactgcatcaactaatgagcaaaataaccagctaacatcataatgacaggatcaaattcacacataacaatattaaccttaaacataaatgggctaactgctccaattaaaagacacagactggcacattggataaagagtcaagacccatcagtgtgctgtattcaggagacccatctcacatgcagagactcacataggctcgaaataaagggatggaggaagatctaccaagcaaatggaaaacaaaaaaagaaaagcaggggttgcaatcctagtctctgataaaacagactttaaaccaacaaagatcaaaagagacaaggccattacataatggtaaagggatcaattcaacaagaagagctaactatccaaaatatatatgcacccaatacaggagcacccagattcataaagcaagtccttagagacctacaaagagacttagactcccacacaataataatgggagactttaacaccccactgtcaacattagacagttcaacgagacagaaagttaacaaggatatccaggaattgaactcagctctgcagcaagcggacctaatagacatctacagaactctccatcccaaatcaacagaatatacattcttctcagcaccacatccaaaactgaccacatagttggaagtaaagcactcctcagcaaatgtaaaagaacagaaattataacaaactgtctctcaggccacagtgcaatcaaactagaactcaggattaagaaactcattcaaaaccgctcaactacatggaaactgaacaacctgctcctgaatgactactgggtacatagcgaaatgaaggcagaaataaagatgttctttgaaaccaatgagaacaaagacacaatataccagaatctctgggacacatttaaagcagtgtgtagaggaaaatttatagcactaagtgcccacaggagaaagcaggaaagatcaaaaattgacaccctaacatcacaatttaaagaactagagaagcaagagcaaacacattcaaaagctggcagaaggcaagaaataactaagatcagagcagaactgaaggagatagagacacaaaaaaccctttaaaaaatcaatgaatccaggaactggttttttgaaaagatcaacaaaattgatagaacactagcaagactaataaagaagaaaagagagaagaatcaaatagacgcaataaaaaatgataaaggggatatcaccaccaatcccacagaaatacaaactaccatcagagaatactataaacacctctatgtaaataaactagaaaatctagaagaaatggataaattcctggacacatacaccctcccaagactaaaccaggaagaagttgaatccctgaatagaccaataacaggctctgaaattgaggcaataattaatagcttaccaaccaaaaaaagtccaggaccagacggattcacactcaaattctaccagaactacaaggaggagctggtaccattccttctgaaactattccaatcaatagaaaaagatggaatcctccctaactcattttatgaggccagcatcatcctgataccaaagcctggcagagaaacaacaaaaaaagagaattttagaccaatatccctgatgaacattgatgcaaaaatcctcaataaaatactggcaaaccaaatccagcagcacatcaaaaagcttatccaccatgatcaagtgggcttcatctctgggatgcaaggctggttcaacatacgaaaatcaataaacgtaatccagcatataaacagaaccaaagacaaaaaccacatgattatctcaatagatgcagaaaaggcctttgacaaaattcaacaacacttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgttcgcagacgacatgattgtatatctagaaaacaccattgtctcagcccaaaatctccttatgctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatatgaaggacctcttcaaggagaactacaaaccactgctcaatgaaataaaaggggatacaaacaaatggaagaacattccatgctcatgggtaggaagaatcaatattgtgaaaatggccatactgcccaaggtattttatagattcaatgccatccccatcatgctaccaatgactttctttacagaattctaaaaaactattttaaagttcatttggaaccaaaaaagagcccgcattgccaagtcaatcctaagccaaaagaacaaagctggaggcatcacgctacctgacttcaaactatactacacggctacagtaaccaaaacagcatggtactggtaccaaaacagagatatagaccaatggaacagaacagagccctcagaagtaataccacacatctacaaccatctgatctttgacaaacctgacaaaaacaagaaatggggaaaggattccctattgaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattgacaaatgggatctaatgaaactaaagagcttccgcacagcaaaagaaactaccatcccagtgaacaggcgagctacaaattgggagaaaatgtttgcaatctattcatctgacaaagggctaatatccagaatctacgaagaactcaaacaaacttacaagaaaaaaagaccccatcaaaaagtgggtgaaggatataaacagacacttctcaaaagaagacatttatgcagccaacagatacatgaaaaaatgctcatcatcactggccatcagagaaatgcaaatcaaaaccacagtgagataccatctcacaccagttagaatggcgatcattaaaaagtcaggaaacaacaggtgctggagaggatgtggagaaataggaacgcttttacactgttggtgggactgtaaactagttcaacaattgtggaagacagtgtggcgattcctcaaggatctagaactagaaataccatttgacccagccatcccattactgggtatgtacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaggatctgttcatgtcctttgtagggacatggatgaagctggaaaccatcattctcaaaaactatcacaaggacaaaaaaccaaacaccgcatgttctcactcgtaggtgggaattgaacaataagaacacttggacacaggtaggggaacatcacacaccggggcctgtcatggggtgggtggacaggggagggatagcattaggagatatacctaatgtaaatgacgagttaatgggtgcagcacaccaacatggcacatgtatacatatgtaacaaacctgcacgttgtgcacatgtaccctagaacttacagtataataaaaaaaaagaaattgcaaaattacacattctttgtaagcacacaaaggaaacatgttagaattttccattttaagctacaaataagctacaaataaagtagtctcaaatttcagataatataaaacatgttttctggtcacaatacaattaaagttgatataaataagaaagataactataaaatcttcctatgttagaatcaagaactatacttttaaacccatgtgtcaaataagaaatcataaattagaaaatattttaaactgaatgataacaaggcatgacatattaaaatgtgggaatcagctaaagcaatatttagaaagaaatgtatagcgttaaaaacatatattggaagagaagaaagcctgacaattaatgagctaaggtatgtctcaagaagctagtgaaacagcaaaataaaccaaaaggaagtagaagcaaggaaataataaagatatgaagtaaatgaagtaaaaaagaaacatacaatagagagaataaagaaaaccaaaagttggttccttgaaaattgacaaacttctggcaagagcaatcaagatgaaaagaaggcacaaataatatcagaaactttaaaaaactggacatcaataaagatcccacaaaaatttctgccaatataaaaatataaaaaatgaggatacttattaatattaaatgttctttcttgttgtatttaccagggattaatccattttacctaattttccaaacttagtgttaaaaggttattaatttaaaaaatccagatccagatggctacactaactatattctaccaatttttcaaaggagaaataatattaaccttgcaaaaattctttcagaaaatggaaaaagatggaatgttattcaattatcttatgataatagcataaccttgacaaccaaaccgaacaagaacaatattagaaaggaagataataggcccgttttattcataaacataaatcccaaacaaaatattagcaatatggatccaaattggatttatgctaggaatgcaagtttggcttatacattagaaaactgatataatttatcacagtgacagactgaaggattatacatattggctgtcctaagcagtgcaataagatgagaaaaagaaggaaaatatgtaaggattgaatatgatgaaacaaactcattgtatgtggaagatatgatggcatagatagaaaatccaaaggaatttatatataaattattagaatttttaaaatttttcaagcttgctgaaaacaaaataaataccaaaattaattgtatttctgtatacctgaaacagttggaaaaatagttttaaatagcatttaaaaattccaagcaggagttgcacattcctgtcagataatggcagctgcctaaatctctccacagtcttcaaaaaccatacatacacatacacacacaattttaaattatgactaaaaccacccataacccatctatagaataaccagaagacaaaaagtactataagtttatatttacaagtagaaaataaatatataaatctagccaaccttgctccagagagaaaccctgtctcaaaaaaaaaaaaaaaaaaaaaaagaagaaagcaaatgttggaaattaactgtcctataaaaacaaaagtgaattactaaatcacaagacccacaaacctctttggtcacatctattaaataaattacacttccatttatcaacagtagagggtactcctggctaagaaacctagtaagccacccagccctcatgtctgcctgcataaatcacctcttattgctgaaacaagaaaatgtaaggaatttctaaatgaacagaaaatagcatatgaagcagatggtattaatgttcttgagtttttattccctctttccttgaaaacctcatcaactttaggcatggccgtacggctcatcttgatcaatagaatgtgattggacatgacatatataccacttccaaatagaagctttaaatgtgattttgtgtttgacacactcttttgtgcctctgctccaggctccagactttaagcctctagaacgataagtgaataaatttcttttgttttaaaggcaccaagtgtgtggtgaatttgttacagtagccctagaaatctaatactaacaaaaagaatgttagagttgaattagaagtgtcagtgagaacttaggaatttaaaaaatcatattcttagcactgttcactgagggaatctagaagtaattacactgcagtaataacgagcccatcccatgcccaaatcttggtctctaactaccattttccagtcaaaagaatctgagctccctagagaaatgactttttcaaggctggatcaaggaaactgccaggcaatcttagatgatcttggtgatcttgatgtgccagaagattaatgggatcatgtgaaaagaacacagaaactggtctgaagggcttcctgttggccagatttgagacaatttgagcatcaaaaggaataatgagggtaatggatcataactggaaaatcagtttgcaaccatcaatgtacttactattgaatacttgtaaagaactttaagggttgctaataccattggataaaagcttgttgtgaaacagaatatttgcatggtctcaaagtctcactccacagattgttaggaaagggaaagggttacctttataaatatagagattaggtggacatcttaaccaagtgatcaaacttagcatcatcaataatgggacaatctggcatcgcatgccccctgatttaatgcagtaaggattaagtctaacaaaagatgtacaaagcctccaaatacagcgtaaacatttgtaaaataatctcagaacagggaccttaatgtttctcaaaaatttttccaaatacagaactttatttctatagatgtttatggtatatttgccatgctatatacattatgctatatattctatgtgctgaagatacaacaatgaccaaggtctttgcccttgtggaactgacatttggtggcggagacagaggaaacagtcaataagcatgtaaagagataaaggaaaagatactgaatgctacaaaggaaacaaataagttgagatttagaacaaaaaagagtcctattttacaagaggaataatgaggaagacctttctaaagaggtagctcagcactttgggaggccgaggcgggtggatcacgaggtcaggagatcaagaccatcctggctaacacagtgaaaccccatctctactaaaaatacaaaaaatgagccgggcatggtggcgggcacctgtagtcccagctacttgggaggctgaggcaggagaatggcgtgaacccgggaggcggagcttgcagtgagccgagatggtgccactgcactccagcctgggcgacagagcgagactccgtctcaaaaaaaaaaaaaaaaattgaggcagaatttcgctatgttgcctaggcttgtctcaaactcctgggctcaagcaatcctcctgcctcagcctgctgagtagctgggactccaggggcatgccactatgcttagtttaagaggtggtatttaaactgagacccgaagggtaaaaaacatggataaaagaagaaacagaaggggtaagagccttccaagcagagggaatcacatatacaaaggctctcatgttaaataaaacaagagttgacattgttgagaaactgaaagatcagctcatctgcgatgcggtaaaataggaggaatgcagtgggagaacagatcagagacttgggcaggggctatattaggcagaacttggagaccagagtaagggggccaaggtgggaacagaccgattaaattggcatctcttgggggggtgggggggtggggaacttacccatgcatcattttttaaaagctccaaaggcgattccaataagcagccagggttgggaacctagggggaaaatgtagctagatgaatgaagatggcccaaacgtcttttgttctgatagctaaactctctgtaggatcacagtgttacttcacagtgcatttgccaggaaaagtctcttcccatttggaatccgaagtaaaactgacaccacacttgaagatgccaggattgttagaggaaaatgtcacccaatagctccaggaagcaggagccctactgttgctgtttaaccacttctttcccattttggtggcaagttgcctccttttacacaaactgcctcaggagatcctaaagatatcatggtgtctgtctgtccttgcaagagcatgcattatggtaggacattgccttcattctgttcctttttctccaagactcttgcttattctcaccatttggctggactttctactgtaggattacctcggaatccacacaaaacccacagggtttcagagttgccttgaattacacgttttgaacattcagatcttcattttcccaaacatccacccagttataggtgacctttgctccaaagtcctggagtagcaaggtgccttgagtcttagactcttcccacttctttctctcttctgcatcccctcctgccaaggttgcccagccacactaaattgcatgccttgctgtgttgcattcgttatcattctaaagttgtcaccaacatgtgcgaaaccagtttatctaataacgatagctaccattttctgagctcttgccatgtactcctcttgccacagcaaatgcattgacaagggagtctgctggccaaagcctgactctcatctccagatggtccaacacagatgctgtgtgtgacccaggacaaagcacttaatgtcactgaggtttgggaagtgggtgagaacactgtagatataaggcctagctagagtgaaggcctccaaagcagggtgctcttaattctagatgtcccagatgcgtaggacagagtcatctagtcatcttccagggtttaatcctggactactggaaacaactagaagtgagaaaagcgtctgtgctttgcagtgaccattgtcctgtcagacaaccaataaatgctatctttcctctttcaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggagacaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttgataatcttattttggcattcttttcccattgactatatacatctctatttctcaaatgttcatggaactagctcttttattttcctgctggtttcttcagtaatgagttaaataaaacattgacacatacaaacaaatgcctttgagaattgtgtttttacactggaaataaaaatgtgaacactgatttttaaaacaaataggggcactgaatagcaagatggacactctagaaaaccaaattagtgagttagaaaaccagattaaattgaactcagagtaaaaatgatataattcatgagagtctgaataaaataaatcagaaatggagcctcaatccaggagaacagcttatatggagagagagagactgagagagaaatgggagtttctgttcaatgggcataaagtttcagctatgctgctgggcacagtggctcatgcctgtaatcctggcactttgggaggccaaggcgggcggatcacctgaggtcgggagttcaagaccagcctagccaacatggcgaaatcccgtcgctaataaaaatataaaaattagttgggcatggtggcacatgcctgtagtcccagctacttgggaggttgaggcacaagaatcgcttgaacccgggaggcgggtggaggttgcagtgagccaagatcgtgccgttgcattccatcagcctgggcaacagagtgagactccatctcaaaaaaaaaaaagtttcagttatgcaagatgaattaagttctacagatctaatgtacaacattgtgcatatagctaacgataccatactgggcacttaaaaatttgttaagagagcagataccacgttgtgttcttactacagttttacaacaatgcaaaaatgcattgtaaacactatgtgcaaatagaatagcaaagaatgtatacagtgcccatgagcataacattctagtggacccacaatgcatcagagttcagtgagactcaaagggagaagaatgttggcaaagtcagtggggaggagaaaatgagtgtgatgaaataggcggtctcattaaacttcccttacaaaacacaagatcaaagataaaattattaagaatttcgagacagtgacatcagagcaaacgaaacatagg

SEQ ID NO: 6 - DNA, 188930 bp, Artificial Sequence
  synthetic construct
tcaccatggctacattctgatgtaaagagatatatcctatacctgggccaaatgtaaacagcctggaaaagtgttaggttaaaaacaaaacaaaataaataaatgaataaatgccaggtggttatgagtgctattgagaaaaatgaagccaagagggatatcagtgatgcaggtgggggtaaagagcttacaacataaatgtggtgttccatatttaaacctcattcaacagggaagattggagctgaaatgtgaaggagttgtgggagtggaactacgtggaaatctgggggaaaggtgttttgggtaaaagaaatagcaagtgttgaggtccaggggcatgagtgtgcttgatattttagggaagagtaaggagaccagtataaccagagtgagatgagactacagaggtcaggagaaagggcatgcagaccatgtgggatgctctaggacctaggccatggtaaagatgtagggttttaccctgatggaggtcagaagccattggaggattctgagaagaggagtgacaggactcgctttatagttttaaattataactataaattatagtttttaaaacaatagttgcctaacctcatgttatatgtaaaactacagttttaaaaactataaattcctcatactggcagcagtgtgaggggcaagggcaaaagcagagagactaacaggttgctggttactcttgctagtgcaagtgaattctagaatcttcgacaacatccagaacttctcttgctgctgccactcaggaagagggttggagtaggctaggaataggagcacaaattaaagctcctgttcactttgacttctccatccctctcctcctttccttaaaggttctgattaaagcagacttatgcccctactgctctcagaagtgaatgggttaagtttagcagcctcccttttgctacttcagttcttcctgtggctgcttcccactgataaaaaggaagcaatcctatcggttactgcttagtgctgagcacatccagtgggtaaagttccttaaaatgctctgcaaagaaattgggacttttcattaaatcagaaattttacttttttcccctcctgggagctaaagatattttagagaagaattaaccttttgcttctccagttgaacatttgtagcaataagtcatgcaaatagagctctccacctgcttctttctgtgccttttgcgattctgctttagtgccaccagaagatactacctgggtgcagtggaactgtcatgggactatatgcaaagtgatctcggtgagctgcctgtggacgcaaggtaaaggcatgtcctgtagggtctgatcggggccaggattgtggggatgtaagtctgcttggaggaaggtgcagacatcgggttaggatggttgtgatgctacctgggccccaaagaaacatttctgggtaaggtgtgcacacatctgtgttattagcagaaatgctaactgccaattcttttcataggtctgacctatttgttgatattttgttctgttttgtccattgcttctcttcgtcatatgctgctcctccagaatctagagactggagtagagggagggtgaagggacaaagacaaaacttccctctgcctgcccaagcttccatagagagaatcaaggcaatgaaatccaatcaatatcacacacaagtttcatgtctggttctcttgtgtgtacatgcaatgtgtgtttttataatatcttttcctactttgggtgtaaggataatatgagccttgagttcagaagcttttcgtgttttgggggttctggtgcatttaggcagagtattaaataactttatcaatattgtctatggtcatcagttgattcagatttttctacctcttcttcagtaaatattggtatattttggtctatactttcatagaaagcaatctactgtccctagatttgataatgtattggtatcaagttatgtaagagtctcctgtgattttgttaaactgttctgtgtctgtagttatattttctttttcattccttatgttgtatatgttctcttcctctcttttaaaaataatatttccaggagttttcttgattttattggtcttgtcaagaattttcttttggtttgatttatcaatctcttttttctttctgttgcatcagtttctgcttctactttcattgatttattccttccttctaatttcctttggttcattttgttgttagatttttgcttcttgagttgaatgctgaaatcatttattttatttttttgtcttctttaaatgtgtattataaagatttaaatataatacatagattgtggctgtgtaaacattaaatgtggtcatgttgtacatactttatattctttttggttctttctgtttggctccccaccctctttccacatcagtccccttctcccccacctcagctaggtaaccccagtatgataatatatattcacatacacatacacacacacaaaggttttcttggacattatttgttttataaaattgggacattatacacacatttctcactcattaacacgtactagaactctaagtcaattggtatagctttaattcattatttttattggctatataagattctatggtatggctgtatcacaatttagtcaatatgttcactttattccagtttttggctactatatcctatatcattacatactggtgcttttacttctgttgaacaaacttgcaagaggaatattaatggaacgaagggaatgtttccttctaagttttaatttccaaagaggtcagaacttttcaaacatttctaccatcgaagtatgaaaatggccttctctctgcattcacatagcgataagttttatcctgtttttaaaatttgccaattttacaggtgtagagtgatattgcatcattactttcattgtgttatttttatttctaataagttgagcatctttttaaatgcttgttggctattggatttatttgggggatttaattagtcatatgatttgcccattattctttggactctttcatttaaaaaaattatgagaacccttttattattacaaatattaactctttgtcatgtatattgcagttttccccaagatctattgtttgtctgttgactttcttataacttttaccaaaacagtttttaatttttataatcagagatatcttttctttcatatcttcagagtcggcaaggttggttaaaaatgtttcccacacctcaagattgtacgtgtaatctcccagattttcttgcaagatgtttactgtttcgctttttatatgcattgcttcaattatctgctaattacttttgtcatatggcatgagagagggatttgtctagttttatttccatccagatcaatagcctattgtgatggcaccttttgccactgatttgaatcaacacattcatcatataaagttctcatatatattagcatatatttctggattcattaggctgtttcactaatctactattatcttgctatgccagtaccatagtgatttgattacagtgagcctatgatatcttctgatatctggtgggtgaaagcaatcctcactattctttttgtacctttcttagctattcttagacactttattcttccacataaaactgttaagatatttttcaaattaaaaagatccaagccctgttgtgattctaactgcaatttcattaaactcagaccttaattttattaatgtaataaatttaaatatttttcttattacatttatctctgtgtattttataagtgtgatgctattgttaataagatagttttctcctatttccatttatgagtgcttagtaccaaatagagataagctattggtttgtgtattttcagctttttcttttgagcctgggtctcattttgtcacccaggctggagtgcagtggggtgatctcaccttactgcagcctcaacctcctggattcaagcaattctcctgtatatcagccccccaagtagctgggactacaggagcaggccaccatgcccggaaaatttttgtatattttttagagatgggtttttgccatgttacccaggctggttttcaactcctgagctcaagcattccccccacctcagcctcccaaagagctaggattacaggtttgagccaccgcacccagccattgtatattcatcttaaatctagctaccttaccaaatttgcctattaattctagtaattttaccctaaagtctctgtgagtattgaatcatatcataagttaaatgagacagattttagctcatttccaatatttatagccagttatttcattttcttatcttattgaatttattagaaaacaagagcaaatgttaaataataacaatgaaagtgaacattccttctactctatgattttacttgaaataatttttgtattttgctatttagagtaacatttgctgttttggtttttgtaaatggtgtttattctattctcatttgccacaaaatgtttatcataaataagttttcagcagctggtatcatctgaattgtcttctttgatatgctgatgaacaaattatgttcatagatgtcctgacactaaatacccttacattcttggagtaaaatctactattcatggaatttgatcattagtgggttctatgtactatttctttagactattcttagtagattttcactactcaacctactaataataataaacaaagttttgttggctttatcaaatgaattgatgagtactccatctttttctattgcttagaatagcttaagtaacatttgaattatccattgtctaaaagttaggtgagactcacttatgaatccatttggtcctagtggcatttgcaatatctttaatcacccctccaggctcttctatgataatcagtcaattcaagtttcaacttccaataattatatacctttctaggaagtaactttatttattttttcaattttgttgccacagtgttgcatgtagcactcactcatgattcttttactccacattatctgtagttatgtgccctttcttattcctaaattcctctatctttgctatttatctttttttccttgaataagcttgccaatgacttgtctattttgttgctggtggtgctcttttcaaagaatgggcttttggattttttttttttctagttggtataaagcatttttattttcactgagcagaaaaagaagctattgattcattaactgtgctgctttattggcatgtagctatgcactgttcacacattaatatataaaactcgtcagtctgttttattttgtctgatgggaaaacatgaacagtgagatttcttatgcaaaaagtgaacagttcaactatgctagctccatatacctttattaacattccagagacttatcctctcaacatgatctgatttctgtaggataacttttcaggaaaagtattttctgatcagtgaagcttggagatataaataagcaatcggccaggtatggtggttcatgcctgtaatcccagcactttgggaggccgaggcaggcagatcacctgaggtcaggagtttgacaccagcctagccaacatggcaaaactccgtgtctaccaaaaaaaaaaaaaaaattagctgggcatggtggtgctcacctgtaatcccagctactgaggaggctgaggcaggagaattgcttgaacctaggaggcggaggtggcagtgagctaagattgtgctcagcctaggtgacagagtgagactccatttcaaaaaataaaaaaataaaaaaaagcagtatctctcatattcattaactggaccctgactttcttaaagctcaccccaaagctgaagtccatgaaggcactagttctcaaacttcagtgtgcataagaatcactcgggaagcttattaaaatttacattcctaggccccatcctcagcaaactatttagtccccaggtaattctatcccaccccaccccagctttattgtggtataattgacaaataaaagttgtatatatttaaggtgtacaagataatgttttgatgtaagtatacattgtaaaatggtatagcatgaagggttttcttttcatttttttcagaatagtttgtaatatcttctttgatttcatctttgataatctagacgtatgattttaattgctttttaaatttgtttatcaagttagtttgtagtatttgggtcaacattgaatatcctgttaatttcctattgctgtgtaacaaactacatcaaatgtatcagcttatgacagacccatttactgtctcacagtttctgtgagttagaagtccaggtggactcagctggatactctgtgcagggtcatacaaggccaacaccaaggttttaatagggctgcactccttagtgaaagctcttggggagaatctgcttacaggctcatttggaatgttagcaaattcagttccttctctcactttccatgtagtgccctctaccagcaatggtgcatcaacactctctcatgcttggaattgctctgacttcaattttccgtgcatatctctggccttttttgcctctctcttttacttttaaggactcatgtgattacattgggccgacctgggtaattcagaatactctccccatctcaaggtcagctaatcagccccttaattccatctgcaaagtttaatttgccacataatatatttttggacatgacaccaaggagcaaaggtgatgtgggccaaatttttacctgccacaggtatagtttacatacaatgaagctcatcaattttaaatatgcagtttgatgagttttgacaaatgcatacacttgcataaccaccaccctaatcaacatgcatttacatcaaccctcctgcaactttttaatgagtctctcccactgacctggcctcagccaataaactgctatctggaagttacagatttgttttcacatgttctagaattttacatcagtggaatcatacggtatgtattcttctatggctttttttcttcagcatcatgatttggaaattcatgcaggttgttgtataaagtatttctatcctttttattgctgattactgctccattatgggattatatcataattttggattatttccagttaggagcaaatacaaataaacctgctatgaacagtgctccacatgttttgtgtgaacatctattttcatttatcttagttaaatatctaggagtggaattgctggatcatatggtaagtgcatgtttaagagaaactgccagacagatttcttgaacgtaccattctatactcccaccagcaatgcatgagagttccagttgcaatatatcctggacaacatttgatgttgccagtacttaatgactgcacagtggtatctcactatacttttttttttttttgagatggaatctcatcccatcacacaggctggagtgcagtggcgcaatctcagctcaacatctgcctcctaggctcaagcaattctcatgcctcagcctcctgagtagctaggactatggtcacacgccaccgtgcccagctaatttttgtatttttggtagagacggggttttgccatgttggccaggctggtctcaaactcctggcctcaagtgatccacccgcctcggcctcccaaaatgttgggattacggcttgagccactgcacctggttatacttttaatttgcgtgtctctgatgactaaagatgttgagcatctttgcatgtgctaattagccattcctatatcttcttggaagtgtctattcaaatcattggtcctttgtttttaaacgtagtttcaacttttattttagactgaggaggtacatgtgcaggtttgttacatgagtatgttgcatggtgctgaagtttgggttacgaatgaatgatcctgtcactgaagtagtgaacatagtacccaataggtggtttttcactccttgctacccttcctcctccctctttcctctagtcgtctccagtgtctattattctatgtccatgtgttctcatcatttagctcccacttctaagtgagaacatatggtatttggttttcagttcctgtgttaattcacttaggataatggtttgccagtttttaattgggttgtttgtcttgttattgttgagttttgataattttttatatattctgggtacaagactattcagaggtacctgttttgaatgtttttttccaatctatggcttgcattttcattttccaaatggtgtctttcaaatagtggaaatttatagttgtagttaagtccaatttagcttttcttcttctatgattcatgcttttttttcccctgtcctaggaaatctttgcccacctcaagttcacaaagcctttcttctgttttcttctagaacttttatcattttagcattagtatttaggtttataatacattttgagttaaattttctgtatggtgtgacttttctttctctattgaattcccttggtgcctttgtagaaaattaaatgactgtatataggcaaatctgtttatggattctctagttccatagatgtgtatatctgtgcttatgccagtaccagattgttttgattgttgtaactttatagtaagtcttaatatcaggcagtctaaaacctccaacttacttttttattgaaattgcttttgatatatttaggcttttatatttctgtattaattttatagtcaactagccaactccaccaaatagccaactgggattttgactggaattgaattgaatctgtagatcaatttggggagaattgacatttaaacaatactgaatctttcaatacaacaacatggtatggctttgtttctttaaattttctttaatttccctctaggatattttgtagcctacagagtagttcttgcaagaattatattaattgtatccccaagtattttgagggattcgatgctattgttaattgtatcatttttatttgttttcgttttccaatcatttgttactaaaatatagaaattcaattgatttttgtatattgaccttgttcactctaatcttgttaatttgcattttagctctagtagcgttttgcacttcttttagaatttctacatatacaataatgttgtctgcaaataaagacagtttgcttcttcctttccaaactggatgctttttattttttttttcatgccttactgtactggcaagggcctccagtacaatgttagatagaactgatgatagcagaatccttgtcttcttcctgatttcagagggaaaatattcattattttaccattaagtacaattacttgtaaattttttcatagatgccctttgtcaaattgaggaagtttccttctattcttggtgtgagagtttttatcaagatttgatattagattttgtcaaatgctttttctgcatctattcaaatggtcatatggtttatcttgtttattctgttatggtgaattaccttgattgattttttaatgaggaactagctatgtattcccagggaaaaaatccacctggttgtgacatattacattggtaatattttcgctatggactgaattgtctccacctccccccaccccaaattcatatgttgaagtcctaactctcaagatgattatatttggagatagggcttttaggaggtaaacaaggttaaatgaggccataaggatggagtcctaatctgataggactggtggcctcataagaagagagaaggttctctctctacactcatgcactgaggaaaagccatgtgaacatacagcgagaaggcagccatctaccagctgggaagagggctccactagaaactgaccgtgctggcaccctgatattggatttccagcctccggaactgtgagaaaataagtttctgttgtttaagtcacccaatctctagtattttgttatggcagccctggccaactaaaactgttttgttaagggttttggtggtgatggtggttttttagtttttgcgtctgtgttcatgatggatatttggctgtgattttcttataatgtcattgtctggttttgatataagagtggtattagtccgttctaatgctgctatgaggacatacccgagactgggtaatttataaaggaaagagatttaatggactcacagttccacatggctggggaggcctcacaatcatggtggaaggcaaaggaggagcaaagacacatcttatatggcatggtggcagacaagagagcattgtacaggagaactgccctttataaaaccatcagccctcatgagacttattcactataatgtgaacagcatgggaaaaccccactgccatgattcaattacctcccacctggtccctctcacagcacatggggattgtgggagctacaattcaagatgagatttaggtggggacacagccaaaccatatcaaagagtaagactattctttttttttttttttttttttttgagacggagtctcgctctgtcacccaggctggagtgcagtggtgcgatctcggctcactgcaagctccgcctcccgggttcacgccattctcctgcctcagcctcccgagtagctgggacgacaggcgcccgccaccacgcctggctaattttttatactgatagtagagacggggtttcaccgtgttagccaggatagtctcgatctcctgacctcatgatccgcccacctcggcctcccaaagtgctgggattacaagcgtgagccaccgcgcccggctgactattcttataaaatgagttgagacgtgttcactcttctatttaatgaaagagtttgtgtagaattggtatcatttcttttttaaatgtttattcaccagggaaatcatcttatcccagtgttttttgttttggtttggttttttttttaagggtcttaattgtgaattctatttttaataggtaaagggctatttgaattttctatttcttataggataaattttaataatttcttttaagaaattccatttgagactgggcatggtggctcacacctgtaaccccaacactttgggaggaggcagcaggattgctctaggccaggagtttgagatcagcctgggcaacataacaagacttgacttctacagaattttttttcattagccaagtgtggtaacatatgcctgtagtcccagctacttggaaggctgaggcaggaggatcacttgagcccaagagttcaaggctgcaattaactatggatcatgctactgcactccagcctgagcaacaaagcaaggctctgtctcaaaaaaagaaaagaaattccatctgagctgttgaatttaatagtataaagttcagaatatttccttaccattttttcactccttggaggtatgatttacatactgtaaaaatcacttattttcagtgtggagattcttttcctttcctaaatctccacatttttattgacatatactttacatatcataaaattcaccatttgaaagtgtacaattcagtggtttttagtgaatccgtaaagtgtacaactatcatctttatttaattccagaatattttcatcacctcaaaaagaaaccctgtaatcattaaacagtcacttctaattttcttcctttccccagcccctggcaaccattaacctactttccgtcactgtggttttgcctattctggatatttcatgtaaatgaagggataaaatatgtggccttttgtgtctagcatcttttgcttagcatgttttcaagattcttccatttttgcagaatgatagaggagttaaaataagaaaataaagatatagtaagaatgaaactattttcattttttaatttaaaaaaatcttccatgttgtagtatgtatcagaatttaactcctttttatggctgaataatactccattgtatggatagaccacattttgtttatccattcatctgttgatggacttttggattgtttccccttttggctattatgaataatgctgctatagaacattcatgtacaagtctttgtgtacatatgcttttatttctcttcggaatatacttaggaatataattgctaggtcacatggtaattctatgtttaacttttagaggaactgccagactttttcaaagcagctgcaccattttacattttcactaccaaagtatgagtgttccaatttttccatattcttatcaacacttgttactgtctgtctttttaattatactcatcctagtgtggataaagtgatatctcattgtagtttggatttgcatttccctgatgacttacgttgttgagagtcttttcatgtgtttattgaccatttgtgtatctcctttggagaaatgtctatttaaatgctttgcgtgtttttaattggattatttgttttttagtactgagttgtataagttctttatttattcttaatattatacccttatcagagctatgacatgaaaatattttttcccattctgtgggtagtattttcactttcctaatagtatcctgtgatgcacaaagtttttcattttgatgaaatccaatatttatttattttacccctttggttgcttgtatttttgttgtcatatctaagaaatcaatgtcaaatcaaagatcactaagatttaaacctatattttcttttgagacttttatagttttagttcttacattgaggtcattgatccacttggagttaattttggtatatggtgtgaggaggggatccaagttcgttctacagcctatatagcctgcagatgagcaatgttagtgaccttgaaagtagaggcccaggttgtcagtagcctggcatctaactaaacaaccatttatccattaaagttagccctgttaacaattaatattgagataattttacttaatacactgtgtatattagtgtccatctagcatgcagcctgaggcacagagaataatagtttgagtataaaattgaattgaatggaatacatcattaatttattatctagctttctgttattgtataggcagtcacatgtatttaccagaaaaaagttgatagaatttttattttaatgaaacccttttatactttagattattttgatgctgattaacaggataagctgactctggacacatcctgacagcctctgccaaggtttgaaataaacagctgggaaaattcagttttatattatctgttcccgcagctgctcagtttcttctaaccacaggtcagggaatataataggttttccgattagttttagataaaatgtgaaagaacagttcatgtcaaggacaatggttgccaaatatatttggcaggatttctatattgaatcccaaaggaaatacacaaacaaaaccccacaaaagttaggaaggagtaaaacccaggaaccctggaacattttgtcatttactatgcagatttgcctgaaagtgagacaggcaaataaatcacatgtttctgccagcgtggaaaatattcactcaaatggcaaaggtctcaggctggggagctggatattgtcctgtaataggttcatctcagaactgaatcacacacttggagggtgttaatgctcttaggaacatctagttattccctttgaatagagtcctgtcctgaatcacatatacttgacctagggcctaggcctttttgtttttctgtctcacaatcttgtttctccatcaattatgtgttttcactcttccctcagagagggaaaaagtgtttctgtgtgctcttgatcctgttccctctctgatcttccaatctattgctctataacatattttatatgtgtcttatatcttcattttagtcagaaacatttatttatttatttatttatttattttttgagacagagtctaactctatcccccaggctggagtgcagtggcatgatctcggctcactgcaacctctgcctcccgtgttcaagcgattctcctgcctcagcctcctgagtagctggcattacaggcatgccccaccacgcccagctaatttttgtatttttagtagacagggtttcttcatgttggcccggctggtgtcgaactcctgacctcaggtgatcctcccgcctcggcctcccaaagtgctgggattacagatgtgagccattgggtctggcctttaatcagaaacatttaaagtgaaagcactgtggtaacttatgttgaaataccttagaaatcaatggaaactgcacagagagggggtaggatagacgtagtggaaccaaggatatgatatggaaaaaggagaaaggtagcaaactagggatgagttggtgaatgtggaagggcataataatgttaaatgactgaaaactacataggcttatgttaagactagtgccatggaaatttttagaggtagatgacattagagtatgtttaaatataaattaatgttcttgcagtgagccgagattgcgccactgcagtccgcagtccggcctgggcgacagagcgagactccgtctcaaaaaaaaaaaaaaaaaaattaatgttactggttgtgttccctagatgtagactctgagatgaagattaacatgcaggaattttatttggagtgttcttgggatcaacacctgaggaatcagggataggcagagggagaagcgcgctgccgggtaggctccaggacagccttgctggatcttacagggagctctggagctggaatgaaccttccaggttggaccaacatgtccaggcctctgtgtccctgcactgagcactcatgaagtgctgtccatcctgggacagggcagagtcggcgctgggaagaggcgtggtctgcccagagagggggtggggcctgtcctggaaatgggcggggcatgccctggtagaggggcgtggtctgtcttgggaaggaaggtgcgtggcccccacaggcaacattcctctggggcaatcccggcgcacacctcagcggaggtgaaggctgacttcccacacccaatggctgggactggggagttctttcctagactgccatccgggcgcccctcaccctcttgctgctcagctccaggtcgtcgtgggttcagggctcagctgcacgctcctgcccgcgccctgggcgtgatggcacccccagcccctgccattcttccccctcaccccctctccctgccactgctctgcattgccctgggttagcctggcggggccaggtggcacccgccgtatactcttgcctttctgctgcaggggcctttctgctgcgggtcccagagctgcagggaggggcggcagagactccccacgtggctcattggcgggggtgctaatcagagttcttttgctgccactctttgattcccaaaccccatgtaatcttcttagtggggacacagaatcatctttgaattcatacatatacagcaccttggaggctggccctccatcctcacagagacctgcctccaagctggagttctacctgtgcctggttgtggacccactccctcatctcttttgctgtacaatgattccccaggtctacacggtgctatatggaattccacatcagtgaatcaaatcctctgtaagatttcagatagtggtgctggctaaggccctgaagggaggaaaggctaagttacgccaagattaggtatcacaatgaagtcctgtcctttctaggatggaaggagttcagtgtgtctggccaccgagaagctggtttgtctctgtgatggacaataccatattgcagcaatccccaacctttttggcaccagggactggtttcgtggaagataatttttccagagactttggggttgttgggaatggttacggcatgaaactgtccgcctcagatcatgcggcattagttaggttctcataaggagcacaaaacctagatcccttgcatatgcagttcacagtagcattcgcactcctatgagaatctaatgcagcagctgatctcacaggaggcagagcccaggcggtaatgcaagtgatggggagccgctgtaaatacagatgaagctttgctccctgcctgctgctcacttcctgctatgtgaccccattcctaacaggccacagaccagtactggtcaggggcccaggggttgggcccaatatggcatattgggagctcagcattgatttttgttgctggcaggttggactttggtggcaacagtagctagatcagccttagtcagtgggaagccacgcttttgggtccatgcattaattctctccctgctgctgtagccacttagctcatgtcttgccagtactgcgatggcctatgcagaggctagctgatgtgaattgccagagtcatttttatatgtgttgttggtttgtgcttccttcaagatggatgctttctgttggcattaacgtattacttggagatttttctagtttgtgtccactcactaatatgcctttgtcccaacttttttctggaagagcttccttatcagtacgctgggccctggccctcagccagtacagaaagtcatttgtcaaggccttcagttggcagacgtgctccctggactacgtgctttctcgggtgtcccagaaaccctggaatggagtgaaatgcagggctacgtgggagagcagggaggcaagaattaagtcggccccacctttgcccaactcagtgggtctccttgagagaggtctgcagtttcaaggagacttttcagccaatctgctgcgagatcctgtgaaggggtgtgaaggtcttcctctgtgactatagattggccagtctctccttgtgtgtccaacagttttcattatactttatgtgaattaatgcaaaactgctaggtttaaactgctcaccattttagggatcccttctggattttaccttccttaaggggaaattttcctcctttcctcagttcatcctttctgccttggctttgacgtggtctggaggccacagagcctcctcctgagaacctctctctggtgtgtctgtttgtgtccgtccctctcctttcgatcattccctgtggttcctgttgggcgcggctcccataaacgcacagagcagggtctgctttgtctgcaacctgatgcattgttatttctcaccaaaacttgcagtccaaacatcacatttccgggccacactctttgtcagagctccaggggcacaaccccggggacctgctggaaggtgccaccgtgacgtgtgcctagatgcgttttccctcagttaccacagcgttcctctggttctggtggctggagggtgaccgcgtgcttcatgaagggggtccttactgcttcgcatccacccttttcacggaaagcactttgtcacatgttttcagtgtttctaagcgattttctgccaatcttgtgtgctaagattgtgtggcagcgtttccacagatttatagctggcaatgaattctcccaaaggaaatcagacaaaataaaatgtttccaacattgttcacatactgacaacttatgtgcttccttgggtgattttacaactttttaagcacatgaataaaaattattgtctgcttttttctccttttttctctcttttttttcttgcatgcagaaagtttataggagggggatcctctggatcaacacccatgggggagtgaaggaagcaggattgggtaaaagaagttgaggtgatacagtctgaataaaggtcagtcccacagggagctcaagctaggatggctctgcagagatgttctctattgaggcaagttgtctggacctatatagtcccacctttaccaggaataaggcatgagtttggatgtggtgactgacttcagccaaaattggttctcagagaggaattcagattagagttgtcagctgtcagcacacccagcagcttaggaaataagtgctttagtcctgaagcggtgaatctggacaccagcctccactgtggtccaccctttctgctgctcagattcatttgcttcataagttctggaatggttccttcaggattctgatgggctccctttcctggggaaacaaaagagaaaggtttggaacacagcacaactcctgctgctttagcttttcttgagtctgcaactggtactcatcatcttccccttctactacccattctagatccctccccccaccaccctctcaattcatacttctgctgctccaagtgggttaccagataaggtatctggtcatcatgccctttgtaagccatgactgtacttgtccatttatcatcaacattgaacaagggaatactaagagatacccaggcagatgacctggctgccaaatatattctcctctgtctccattgtgtaatgtcagcccttcctcctgatgatcaggatcggttacgcttgccaggatagtgactcttttccttacctcttggtctcttaatagtgatctgaagtaatatgatggcaaccatagtttcaagtttaatgagactcttggtgtgtccactggcggacatattccccttttaagaaccagtacttctaaactctcagagcccagagttgggataagaggcatagtttccctaattgggtcactgggagtaatggtagtgtgaggctgctcctacttacactccttgttttccaaaaccatatattttacttcgggacacaccccactaaacgatggccattgatctagagtatatactgcatcctgcaggatggtgcctcgtccttaggtattatgtctaagctagtgcctcagctgtgccttcaacaagctgtcctaccactctatcaagtgggtagcttctgggtagtggattccatggtcatgtatcttcttgctttaaagtaggtctcttggtctgatgcagtgttatgtaagatcaaatattctgtgaggccttgaatggtggtgtttactgaggctcaccaagcaactgaatgattttcttgagaaatggtgacatatcagagccttagctttggtctctgttactggcaagttgaacattaacaacatcagtagctagatctgtattgatgagtccatgatgttgggcccatgcatagcctctgccatggctcctcctttcatacatccattttgtaagaattggggcaccaacagcagagactggtaagcatcaaagtggctaagtcattcagtctacttggttgtttagtgctgtttctgtggctgatgttcttttcatttattcattctgtaatgcgtatcctttgtagattcaatttccttctctctgaacaacttctttggatatttattgaaaggcaggtctactgtcaataaattccttaatttttattgtctgagaaagtttttatttctccttcatttttgaaggatactttcacagagttcagaattttaggttgactgttttttctttctctcaacactttaaatatgtcagtgcactctcttcttgtttgcatggtttctgaggcgaagttggatgtaatttttatctttgctcctctatggataaagtgtttttccccatctggtttcttacaacattttttgtctttgattttctggagtttgaatataatatgcctaggtgtagggtttttttatttgtttgctcgtttgcatctatctttttttttttttttttttttttgagacagaatctcgccctgtcacccaggctggagtgcagtggcgcgaactcggctcactgcaagctccacctcttgggttcacgccattctcctgcctcagcctcctgaatagctgggactacaggcacccgccaccacagctggctaattttttttgtattttttagtaaagatggggtttcaccatgttagccaggatggtctcgatctcctgacctcgtgatctgcccgcctcggcctcccaaagtgctgggattacaggcgtgagccaccgcgcccagctgcatccatcttctttggtattctctgagcttcctgaatctgtggtatggtgtctggtgtctgacattaatttgggggaaattctcagtcattattgctttaaaaatttgctcctattcatttctgcattcttcttctggcatttccattatgtgtatgttacaacttttgtagttgttgttccacagtttttggacattctgggcccatgcatagcctctgccgttgttgttggtgtttttttttttttcagtctttttttctctttgcttttcagttttgattggaagtttctattgtcatgtcctcaagctcagagattctttcctcagccatgtctcatcaaccaatgagcccatcaaagacattcttcatctctgttacagtgttttgatctctagcatttcttttttattctgtcttagaatttccatatttttccttatgatatacatctgtcattgcatgttgtctactttttacattaaagccattagcatattaatcatagtttaaaaaattcctggtctgataattatgacattcctgccatatttgactctgattctgatgcttgcttgttcagtctcttcaaattttgtgggttttgccctttagtgtgccttgtaatttcttgttaaaaggtggacatgatgtactggctatgaggaactacagtaaataggcccatagtgatgtggtgagatggaaagaaagaaaagatgctcaacatcactaatcattagagaaatataaatcaaaactacaaagagatactgcctcacacccattaggatggctactatcaaaactaaaacagaaaataatgaatgttggtgaggatgtggagaaattggaacccttgtgcactattgcaaatgtacaatagggcagtttctctaaaaattaaacagaattaccatatgatccagcaactcgacttctggctatatatgcaaaagaactgaaatggggtcttaaagagatatttatacatcaattgtattagggttctccaatgaaacagatccgtgtgtgtgtgtgtgtgtgtgtgtgtgtgtgtgtaaatatatgccaatggtaaaagtacagggtctgagtcagaaggcagaaccaagaatgcttatgtccaagggcaggagaagacagatgtcccagttcaaacagggagagtgaatttgcccttcctctgtctttttgttctattcaggccctcagtggaatggataatgcccacccacattggtgagagtgatcttctttaccaattcacatgctattctcttctggaaacatcatcacagacatacctagaaatactgttttgccatgtatctgggcatctcttagcccagtcaagttgacatataaaattaaccatcatatccatgtttataagcagcattattcacaatagctaaaatgtggaagtactgcaagtgtctattgacagatgaatggataatctaaatgtggtatatacacacaaagcattacgaaagaaggaaattctgacacatgctacgacatagatgaaccttgagtatattacgctaagtgaaataagccagtcatgaaaagacaaatgctgtatgattccacttatattgggtacttagagtagtcaaaatgatacagaaagtagaatggtggatgccagagactggaggaggtgagagttattgtttaatgtttatacagtttcagtttacaacataaaattaattctggaggtagatgggagcatattacacgttttctttttggagatgggatctcactctgttgcccaggctggagtgcagttttgtgatcatagctcactgcagccttaactgtctgggctcaagtgatcctcccaccccaggcaccaaagcagctaagaccacaggtgcacaccaccacgcctggctaattattattatttgtagaggccaggtactgctgtgttgcccaggctggtgttgaacccctgggctcaagtgatcatcctgccctggcctcccaaagtactgggattacaggtgtgtgccaccacacctggccagaatatttaatgctactgaactgtatatttaaacatgcttgggctgggcatggtgcctcatgcctataatcccagcactttgggaagccaaggagggtggattgcttgagcccaggagtgtgacaccagcctgggcaacatggtgaaaccctgtctctacaaaaacattaaccgggcatggtggcacacgcctgtagtcccacctactctggcggctgaggcgggaggatcactcgaacccgggaggtggatctcgccactgcactccagcctgagcaacagagtgagaccctgtcaaaaaaaaaaaaaaaaaaaaaagatttacgatagtaaattttatgtgtattttaccacaattattaaaattgaagaaaatccccatgggtcactggtttaccaatttagccattttcaccatttttagattgcattttccttctctatctcagcattctgactaaaggaaaagcaaaatttcttacaagaatgaatgattctccagtgtggctgctcctgaaaggaacaatgagacttttgttatttcaccacaagactgagaaagaaataaacaagtgataaatgcccagaccccttcttattcattccacatcctggtaatctgaggcatggtgtggcttttactccaagcatatgaatacttacaatcagaagctgcctctcctttccctcactttatcattattgccatcatttatgacaatggagggagtgtctcactggatgatatttggggttctttcttcagtggtccgccataccaagcatttatttgtgctgttctccatctttcacatctaccacttttcaaaagtccctgagagtcaataagacatgcgactcgaacaactgcttcacatctaagtgtatgtctttaaaaatctctccttttccatgtttatgtctgatgtgttttgttatggcaaagtggcatgtagtatacggttcataagtgaatcgatgtatatctgtggagggcaaatgctcaattttagatctacacatgaaagcttttttccagggcaggagccttgctttctccaactaagccttaattacccaaatgcccatgtgttgtgcctttggcttgttgaaatgataccaactggtaaaatctgatgggagataaaagttagatgtccagaagcataaaagtcaggaagagaggctctttatggcatagagaaagctgcagaactgctccatggtgtgcaaaactcatcagcacatgaaactagtgagtggagatagtcaccttcaaccactttgtaatttctaccaattcacttggggccagtgtcccttattcaccaagattcacattggtccttttgattatttggcgtgaggaggcccccagacatgctaaactgtcatgcagggagagaggaaaagttgggaaccagcctttgcttaaaagggctttgacaatggaggcaaataataacattttgggaacatttatataagtaattatataatttctgattcagtagctggttcatgaataaatgagtaattgggagtatctgagtggagacaagaatgaacattaatgtaggactgattctgaattacagcttctggcactagtaggtttcaatatacatagtctgctgaaaggtaattttctctgtgatattcctggtatccctaaggagggaagtataattttaggtacatactgacaaaatttgaacacaaggtacttagatgaaagttatagtctgttttagagatgaaattgaaggatgcagtagctattgctttggcaaaggatttttggctgatgcagtgtatggttattgattttatgattcttatcatatggcacctaatgtatcagttgagttgtgaaaacagtgtttcggtttaatggatgttagggatttatatacaacttcaaatttgcctccttgctaatagtagaaaagagtagtatggaagcattacttccagctgctttttgaagtgtccaccaaaatgaacgactttttcctttcttcacgcagatttcctcctagagtgccaaaatcttttccattcaacacctcagtcgtgtacaaaaagactctgtttgtagaattcacggatcaccttttcaacatcgctaagccaaggccaccctggatgggtaatgaaaacaatgttgaatgctatttatgaaattgggtatcttattttctatcacagattccccaatcttgaggttgcagttaaaaagtgcagctgccaaagagaatgtttccctaactgctacctatagggaaatacactgactgcattttctgtctttttgctgggccgtcttcctctgcttggtctatgccaactgcttacctccacttagatgtcaaataaagtatgtaacaacatgttatgacaggacattttctgtcttagaattgttgctgagaattataggtgggaagtatccccttattctaaagagagatatcagcctatcgatttagaacttgttcaggtagtagtccaaaattggttctgcaacccttaggccctgactcacctccaaccttgtataaaaaaaggctaggaacttatggaagactttagatttgaatatttattatttggagagcctcttcggtgttttatgtgttgcttaccccatggggagtgggaggcctgtccctcatgtcaaggtataatgaaggaggcttcaggagaaccacttagaagactggacaaggtacctatggaacttgggagacactgaccactgcctggtttttatctggataaattttcaaggtcagaggccaaaaggacttctcctgatggaatagcagggggagtgggcaatagtgggagctaactgcactaccattgttaggtgtaaggccaggaaggtcactgaatgggacttgtcttacaaagactctgcctgagaggtcttcctgccaggattagataaccccaatagaaaaagcctgtatgggttgtactgccagaagcagaatctgagaggagagatacaagtgaccagctggagaaggtatatcccatgccaagatcaggagcagtggggtgtctccttgttggcagggagaggtctccaaataactcataagttccctaagaaagaaaggcagaattttggtatgtgtcacaactagggagtactaatgccacattatcactgctccttccaagaaagactttgtcattgtgcctatttgtttttaccctcccccctcctttccacttgctcctaccttggcaggtccagagacacaaaggtgagttggggaggaagattaggagaggaaggtgggaaagcagcgaagctgccaaaacaaattacctttacatattgcagatttctggggctgtcagaatgtagctggagaaggaagggaacttgcaattgcagaagacatcaaaaatttggtattagactggactggacttgttagaacctaagagtgatactgttggttaatacctgaaggttactggaaaagatttgggatcaaccaaagtgcaagaaaagggagatctcacataaagtaattaaaagcagtggtctaagaaaaataaggctattttatgtttttatcccactcaatccagttcattcaacagactgtttataggcattttatacttagtgtattcataaaacagagctcttaattttcctcctgattttctgtcatggcctgactaacaacccagttgcacaagccaaaatcataggagttttctttgactcctctctttttttctatctccacatcatatttatgagcaagtcctgttgactgttcctccaaaacaagttccaagtcttcttattttacttcttgtaaaatccaaattcatccaaattcctgtggcctgcaaggtcctacatgttatgtttcctttttgaccatattttctgttactcctctgctgattcactgtgcttcagccacactttacttgactataccaaacttatttctgcctctggacgtttgcatttgttttatctgttttcaatgctcttccactagatctttgaaaatcttgcttctttttcattagtcagatctctactcaaatgtcacctcctcagagaggcccttcctgactactacactgaaagtatcctctacctcctgcctcatcactttctagcagaccactatcttttatatttataacaacttgaaattttcttatttatttctttatgtgcttaatgtcttgagaatatgatctccattatctgtcttgtttgctactgcacctccagtgcataagacagttcctagaatatagtaggaactctagttgaatgaatgaatgaattgaatgattgccagaaatcttgcctcagagcaaccataaggttaggctgatgttggcagcaagcaaatactactttttgtcagtaattacaggggcatgcttctccactgtgaccttgactctaacttttggaataacaggttttctggagtactatccccaagtaacctttggcggacatctcattcttacaggtctgctaggtcctaccatccaggctgaggtttatgatacagtggtcattacacttaagaacatggcttcccatcctgtcagtcttcatgctgttggtgtatcctactggaaagcttctgagggtgagtaaaataccctcctattgtcctgtcattctatgaatagaacagtgagatgtgtgtgctttgtaatggtggcgttacaactcttttaaggtcctaactgaacattatgtgtatttcttaacatttactagattataaatatctcaagatagggaaatccatcttatttattgctgtgtccttagcatataacatattgcctaccctatagtagatactcaatacaagaatgagggtgtagtggacaccagtcattttttcttcctaaaattaaacatttctcacctgtataccccctaggaattgcttttctgaatatacttcaaacagaacctgccattttcttaaagcccatgcctccctagccatagcagttgatctaggagtgagcagttgacacgggtatcccacctccttggccacagttgattggtccagagatgggcaccttacccaagctaggccaatgagagtacttgcactagcattttgaaatttatgagaaaaaggacctattattaccaggtaatcctatacttaggggatggagcccaaatataataaaatcaagattctactacttcatgtatatcatgtgggccatggatcttataggagtcttaagggggtgttggtcttgtccttttcttagttgcctagctctttgcaggcatggtgcaaaggcaggacaatctacctttatctgctccttctataccactgatcctaccctaaacatgtagctgtataatcagagacaggaagccatggcaaatctggagggtctcggcttggctatatcttaaagagttacatgtattcgtagttcaacattggggaaattttccaaaaattggtggagaaacgagtggccaatgcaattttatctttttttttctgctgacatcagggagagataagagctttaaaatcacaattatggggagataatattttaaaatccagctcaagttaaacccatcagaaaaggtaacaccttttgggacccccaaatggccacatcttatccaatgaggggacaccaaccatagagtctatactgcacagttcaaatggtagccatgagctatcaggcacttgaaatgtggtgagtcctacttgagacatactgtaaaatatacaccagatttcaaaggttaagtacaaaaaagactaaaaatatctcattcattgtttataagtacaagttgaaatgcttatatttggatatactaggttaaacgaaatacattattaaaataatttcacctgtttctttttacttttcttaatgtgactaccagaaaatttaaaattacatatgtggtttgcattatatttctattgaacagtgaaatgtttagcatatgttgaagttgctgctcctgatgcagtggctcatctcagatttggccaagttcttctgtccaaggaaaactaggttcaacccattcctggagaggaacagactcaaatctttctgggctgggtcacttaccttggttaaatctgttctccacctattctaccaacaaccaaagggatggacatagctgaaataaaaatcacgcaatcacactgaatggtatctcacctcaggtgggccttcagcattgcctagccattctactgctacatttcccctaatccatttactctccctctccccaagacagctataatgtttcacacattgttagcctctcattgaacctccaacatgtgctcccgcccctgcccccaccacaacgtgagccttgggaaaaagggtatttttttcctaatgaaatatttcaaacaaagataaatacagaaaataatataacaaacaaacatgtgcccatcacctcactttgccaaatcttaacattttgtcatctttgcttaatttattttacaaaattaagcattttacatacagtctgtactcctctatggggctggcaggaaaaggctctcattgtcaaagttcaaagtaattgatcattgaaaaaataatgatcacattaaaaacaacacttatataatagagatacatattgtaatactcataaatgaaatgatatcctgtctaggattggcttcaaacacatccaagctgatgttacaatcattaggtgaattcctgatgtggaatttgacatttgtatggcgccaaaataatatcccagtgatttttttctgattgtaagtggaaatgttaactttagaatggaggtatcaggctaatccacaggtcagttttagtgtcactaaggatgggatggccagatattatctgcccctgatatggcacaatatgagggactcagcatcatctttgatatattttagccaaaaaacttatttaatttgaatctaatcagaacttaggcatattcaatagcatgggatattctacaggactacaagccaaatttctttcaccaaatgagtgtcagaaaaaaagggactactccatactaaaagagactatgggcctaaacaaccagatgcaatctgcagtcttaggttggattctgatttggaccaactagctacaaaggatgcctttgaggcaattaagaaaatttgaatattgcattgatattaggtgatattaactggatcaggtgtgctagtgtcattttgtttatgtgggcaatttttttttaaagatgacttctaaagtatataggagtggactatcatgaaatttgtaatgtacattaaaatgcatcatcataaaaagtgtgttgaaagaaaaaagtgaaagtagcagtgcaattctaagaataattttctaacatccactcacaaaaatattaaattctttatattaaacacatgaaaaagaacacaaatatatctgtctttcaagattcatctcaaattccacctccttcatcaagcattactgaagagtaggaagcttgtttactttttttatccactgtgttgctcgctccaagggcatagagacttctatcttgatctttatattttcagcttgtagctgagtctggtaaagaataagaactcaataaatatttgtgaataaataggtgaatatttccacatggtattataattatatctttatatgtctatgtcccccaccaaacatagtgttgtaccactaggaaagaacaaagtttaagaaattttcttaaatctctctttcttactgttccgtgaccctcactagtgcctaccaaagagtctgtgacaaagtgtatttgttgttgaattgaattaggcaaaaagatgcaataatggaagcaatttattatttaacagaatgtggagatatcaaccagaacctagtttttactgctcatgctagggttagtgatctcaagatcctctggagtatatgaagcttctccccatttgtggctgctgcttgttagtttttcaaattaagatgcagaaagtaggccgggtgtggtggttcgcgcctgtaatcccagcactttgggaggctgaggcgggtggatcacaaggtcaggagtttaagaccatcctgaccaacatgatgaaaccccatctctactaaaaatacaaaattagccgggcatggtggcacgtgcctgtaatcccagctgctggggagtctgaggcaggaaaatcacttgaacctgggaggcggacgttgctgtgagccgagatccagcctgggcaacagagtgagactccgtctcaaaacaacaacaacaacaacaacaaagatgcagaaagtccgtttcttatgtagaacctattggtgacaataaacttgacatgtttctttgagtgtacagtggatatagaaaggacaattttatttcttcctgctataggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaaggtaagtgtatgaaagcgtaggattgagatgaaataagcagagaagtacaaacaactgaatctatctataacagttagcatttgtgttccttcacctgaaagaggcttttttactctagcatcatgctcatggaaaggagaataatccagtttctgagagaagcagatatgcattctatataaccacaataaactctaagctgggatcaggaggagctgagttccagaattaaatctctctcctcaaagcattgctattttcctcttcaaatctgtgggctttatcagtagtgatttctactgtcctctgccttttgcaaactttgagctaggttccttgaaaacttcatggaggtaaacacatccaagtgtgtgatcaatggcatatagactggttcaggtggttagtttgtcatctgtaaaccaaaagtatataaaaatctaagaaaagtcagcatttatttatatgttactgaaaattaattaatttggattgaattaatatattctaaaataattctaatcaaacctgtttttaatttataccttagcataaattagggaagtaaattttgcataatttgtttttatcctattttttatggtgaaatcagcttcactgtaccttttccttgttccatttatcttttactgcataactccacaatttagtggcttaaaacaacaacagtctcttattatctctcatggtttctgtgagtctcatggaatttgtcagtgttttgacttggtggcctatctaagtgtgtctcatgaggctgtagtcaaacagtggctagagctgaaatcatcccaaaggtgactttattcacatgtctttgaccttggcttgatggtactctccacatgatctctctcacatgggttttacagggtagccagacttcttatatggtcctgagatagcccattagaagctgtttcacgatttctaatgtaaccttggaaatcactcacataacctacattctattagttagaatgcatcactaagaccagtctataaagggagactccaccttttgatggggaataggcaaagaatttattaacaggaatcaccatactctttctgaatggtgatgatgaatgtgattcaaaaaaaggatgggagcggggagtggagaagatgagaaaggtttgtagtttataatagtttcagatgaaagtatgatttctcatatactgagttcagtttcatagtcataattaatgagaaagtgccaaaaccacagtgtattatttatgggatgtaaaggctaatggaacaatgagatcatcaaaacattagtgtttacatatgacatataaagaaataagttaaaaacccaaatgattctttgacacagagttgaactaaagagtctacagaggttctagttccaggtgaaatggataaacacactccaccctttatttcccattgaacttaactataaaaccttgacaaaatgcaaagcccagatatttaaaaatttctaaaaagcaaatagaacaagtatatagagaaaagacactagaattgaaagtattaccaaacttgtgggggagtatacctttttccccactctagtattccttaacctgaattaaaacataactggagacttcgaagtgagtactatgttgcaaagagagctccaggacaaaccctctggggtttcaaggagtgagaaaggtaactctaaatgctcagagagcgtgggaggggaaatcccctagggtttttgtcctcttttccaccattctctcaagcttcagtcccaggttgcctgtggcaatgacagtggctggcaacagaaacctgccggagtaaaaacttagggaggggaacattattcttcattcagtacagctacagatctaagacattgggggaaaagcacattactttctctctgtctttccccttccattgcttgaccttagctatgatgtagttgtggaaattggaagcttctggttagaaaaccaaaaaagggagctcacagaactggaaagtttatagatgacagagagaaaagatcccaggaaagtaaacccataaagttgtgcattaactcctggattcacccccaacctacacatccaggtatgtagtttcagtgtcagatctgttttaaaccccttgcagtgccattgagtccaacgcagtggccagtctggtgcttgaggggaaatctcagtttcacagtcttcaacatgttccattagcctttacgtcccataaataacacactgtggttttggcactttctcattaattatgactatgaaactgaactcagtatatgagaaatcatactttcatctgaaactaacgcccacagaattccttaaaacatgtctgatggctgaaagcaaagatagaacattgtgagataggttttttaatgtatggtagatacaatacataaaagaatcatagcataacaagaggagggtaaggaaaactttatggtccattcaacttcattccaattcaaatggtaaaatgttgactctaagtagatgatagtgaaaggttaagtatgtattttgtaatccctagagcaaccaataaaaaattataccaagagacacagtaaaaagtcacaataaactaattacaatggtatatcaaaaatattcaaataactcaaaagaaggcaagtaaggagagatgaaaatcagagagaagaagcagtaaaatcataataaaatgataggcttaaatctaaacatatcaatacttacattaagtgcaaatggctaaaacacaccaattaaaaacagagattagcatactggatataaaagcttgaaccaattatatgttgtttacaagaaactcatttcaaaaaaatgatataggtaggttaccagcataaagatggaaaaggatatatgatgcaaacatgaatatgaagaaagttgaagtagtacaaatctgtaatcacaacattgatttttgccaggagtgccaaaaccattcaataggggaaagaatagtgtcttcaataaacagtgctgaaacaggtgaatatctgcatgcaaaatactgattgagtatcccttacctgaaatgcttggaaccaagaacgtttcagatttcagatactggaatatttgcacatatataatgagatagcttggggatggaacttaagtctgaatatgaaattcattttggatataaatcccttgccagttatgtgattggcaaatattttctcccactctatagtttgttttttcattcttttaatggtgtcttttataaagcaagagttatatggacaaacatatgaaaagatgttcaacatcattaaccattagggaaatgcaaattcaatcaacagtgatgtatctattagaatagctaaaataataatataaaattgccaagaatcctgtcaagaattcagagcaacagaaagtttcacaatgcacaatggtatagccattctggaaaacagaatggcagttttgctgcttggtagagaaacagtctctggcagtttcttgtgaaattagatgtacactatagagggatagcaggagggagttctttttggatattgaaatggatctgtatcttgacgatgatggggtttcatgagcttatatctttgttaaaagttatagacctatacaccaaaagaaaaagtcaatttcactataattgaaaatttatataaaagtaattagaatgttttaagacagctttatacgtattttaaatgtgtctctaaagtttttaatccagtacttctggtaaagatggcacagggtcttcctacttagccatttttccatcctccacctcaaccccaacctcgctgaaaaccaacaacaaagataggtaaaccataaatagagaaaatcgaataggcatggtcagctgaaaaagaagataaatatttgtggaccagaagcagaacaggaactgtgagtagtaaaaggggtggaaattacaggccaactgagatctgggtcaggaagccagctgcggtagccaaggagtcaggatgacaaggataaatagtgctccccaccagagggactgagagcccatatcatagagttgggctcttcttcacttgaaagagagctgagcacagctgctgctcactctttgtttagggccatggctttgtggaaactcagagtcctagaagaggggaaagcaaacccagtcctagaataggaactgaactaagttttcttggttcagtgggggaatctgcaatatccccaaggtttccattggccagtatctccaaaattccattctagggtatgatttgctagatagagaatagtgaacacatcctttgcttaatcaaccaatgatcacaagggacagcaaagatcactatagttcaacaaagtcagatttattggctcatggcaacaagagactgtggacacctccctaaacaaagggaaatactgtatagagttagtaaagaattttggggaagggtggaggttaggtgatatttaaatgaagcaaagtagagttgtgtgtaaagaaataaccatgaggtctagactgtgaagtgttctaaaaagttaacatagacatgaaaggttaagtcaaggcaccccttacctgaagcttgagctttaaattgagctgcttctttgtgtcaaagtaatttagatgacctaggaaagaatgagatgtttcattcttgttgctattagttcaaacatttctggcaggctgtgaattcagagaacaaacaactcaattgagtaagaaagcaagagataatcaaagcaaatagttggcattcagtgagtttatacagtggcaatgtgtccttgggagaaatggtgttgttaactctgcagttagctttatctatgtctcttatcccagcctgatgagtagcagcacacgtactgttgctttcttagtccaagctaatttttatttctaagcattaagggtgcgagagagagaaagaacggcaaaatgtcataaacaaaaatctttctactcaaaataagcctgtaaacaaaagtttccagtcaaatttaaaaaatatataattctaagaaagatagccaacaagctcaacagttaaagcatgaaacaagctagtttgttccattaaaaacttcagctatcgatatacacggtatttatttaaaatgtgagtataattagaagcactgtgggctattgaaaaaaaatcatgagtatagatgtttaatatggacaattgctattttactcaaaacttttaatttacaattgcagaagtataaaaagttacaagagtaacagaaattatctataatttcactattatcacacagtgtgtgagggcttgtattttgtaagtgtttttaatttttttctttagtaattcatttttatcatattttacacaagtagtggtcttcatcaaagttgaaataaaaaaattctttgctccagatagttttagaaacactgctataggagacctgacatcaaagccaagttatcaagagacagaagactacatttgttcttactgtcaagtaactgatgaagaactgtctcctcctagtgacaatttcctacaatgagattttttaaatagaagataaatgttctcacttctttttcagggagtctggccaaggaaaagacacagaccttgcacaaatttatactactttttgctgtatttgatgaaggttagtgagtcttaatctgaattttggattcctgaaagaaatcctctgctactattaagaggaggtgattatagaaagatcataaattacattactgttcaggaatgaaggagatggggttaaaaatgaattccaagaaaacaaaacgtaacctcagttccactggcagctatgaggtaagaagatagaggagctggataacggactggcctcatccccctcattaagactgtcaacaaatactttgggctctactttctaaatactttctcttatcttcatctattattaagtgcacaacctttggcaagttatttaacctctctgtgtctcggtttcctaaatggaaataatagtacatttttcataagattgttgtgagtgctgagtgatttcacttaagtaacctagagcactgtgtggcatagagtaggccctcaatagtgttagtacctccgcctcttcctcctcctcctaatgtaatcactatgtaatcatagtaacataatattcttcttgcccccttatcaatttacattgccatcttcttaattgaggccctcatgatctgtctcataactctcaaaggaagcttactgaagtgagtatctgatcttgtcactctagcctctacaatacttcagtttgccagtttcggtggctcatgcctgtaatcccagcactttaggaggctgaggtgggcagattgcttgagcccaggagtttgagaccagcctgggcaacagggcgaaaccacatctctacaaaagaattaaaaaatcagccggtcatggtggcgggtacctgtactccagctacttgggaggctgaggtgggaggatcacttgagcccaggaggtgaaggttgcagtgagctgtgattgcgccactgcactccagcctgggtgataaagccagaccctatctcaaacaacaaaacaaataaaataattcaatttcaaggtaaagtgcaaaatgcattatctattctctggtgacatttccagccttgttgtgttccatttcctgccttatcttccatgtcacccaaatatgtaatgctttttcttgcatgagacctctgcatatgcagtttcctctgcctggaaaaatctgtctccctctttacactaagtaagcttctcctttttctttaagtctgacttacttcagttatccccttccttaattccttctcccaggatgacctctagtctggattagatgcctgcttatatttccacagcatcttgagcttattccttatcatactatatcagtattttctactttatttaatatttatcttctttgatctcatatctttttcccttcaagcaaagtgaaatttcttctcctctctgctccctgtaacaccctactctcatctttattatatcactctttactctttattataattatcagcttctctgacgattccagctagagtgtaagcatcttgaaagcagaggctgtatcttcctctctatcatcagtgtctacaattagtagtgctcaataaatatgtgtttgaatgaatgaacaaatgaatggctgcctcataaagttttagcactagctaccagtccttcacacaaaggggtaactccagggagtcactgttcaatagtatttccagtgcttcagcccttatcaatttcagagacagtgttagggagctttcaggttcctggggtttcataaatataagctgggatgaagcaattataacggagacagggactgacagacagcctttttcctaggacaattttcttttttcttttcttttttttttgagatcgagtctcactctgttgcccaggttggagtgcagtggcacaatcttggctcactgcaacgtccacctcccaggttcaagtgattctcctgcctcagcctcctgagtagctgagattacaggcacatgccaccatgcccgcctaatttgtgtatttttagtggggatagggtttcaccatgttggccaggctactctcaaacgcctgacctgaagtgatccacctgcctcagcctcccagagtgctacgattacaggtgtgagccaccgcgcccggcccctaggatgattttcataagctttcttttaaataattcagctaataaaaagaattgaatcctgatgcctcaagctaaccaatattctgtcttctattattatccattcccacttattgtcatggacaaatggagggagagaaaatcagtttgagcaagagatgtctgcctttacataattatcttctccctccctcacactgactttgagaggataagtgctgtgtgcctactttgctgacaaaaatgcttaaggtgtgagcacactgggagcagggaaggagaaaggggaggcggtcattcatgagacacatgcttagctgactctatctttgccttctctctcatcagggaaaagttggcactcagaaacaaagaactccttgatgcaggatagggatgctgcatctgctcgggcctggcctaaaatgcacacagtcaatggttatgtaaacaggtctctgccaggtatgtacacacctgctcaacaatcctcagggtcttccaaattcagcaccagagttctgtacttcagttcacaaacagctcggcatctcagaggatatagcccactgaatacttgaagatctctggcctctggggatcttaatgtatagtaggcaattcctcttttggtcacctgaaaatgaaggcttacccatgtacatacagcccacagtcagatttttctttccttttcttaaatgtgagtgggcaaccaaggatgaacagacatttaaaaagaacctaaaatatggaagggatatgcaaagatgaacaaagaaaataataatcccagaataaaaaaagctatggctcagaacagaactcatcggaagctcttacttctattttcataaagattcaagaagatactgcatcaataaagtaacaataagatgccttccagttttaaaataggggcatagaggcaggctggctttactccctctcacagaaaaccaaaaccaaacatacagcaccaatatctacaccaacaacaacccagagctcacatgtgaggatgagacagttcccggagccacagagaagtgaaaaaactttgagaatcagacttccacatccatgactctccttcctcctattctgcccagcaccaagtgtatggaaaatctcccctcaactcatggtttctacactggaaaaagtgacattgaggtgttcaaccagcttctccaccttcttgggttccctggggggagatttgtccttgccttaacccacagaaaacatcatgactgtctgaaggcagaaatatcccagagtacaggcagagacaaatgagggaggaaggactaccatccccagccctggaaattctgctctataatttggccaaagacatgcaaattcagaatggccgtgcagcagcaccatgctgtagcaggtttatcctacaggtcaccttggcatgaatcactagctggccttccaacactgctatgataatccctttgggacctcacccacttgggacaggcagggctctgaccacttactggaacacctgtaatcccagcacttgagctcagcacaataacaataggagatggctactaccgttaattttatgcagttacgatttaatactggatctttacgtttgtttacatttgtcccaactggcaccttcatcacctccaccctccccaccccagactatggtaaccacgattctactctctattttcacaagatccactcttttagctcccacatgtgagtgagaacatgtggtattgccctgcagtgtcacctatgttgatgcaaatgaaaatattcttttttatggccaaatagtattccattatgtatatataccactgaactgtacacttaaaaatggtaatgatggcaaattacatatgtatattttacatcaataaaaagaaacttaaaaataaggtaacaataggattctatgaaaaacaatcataacaaaacgtgctcataaaaattataaacacaatggtcaaaatagaaactcaatagaaagtactaagaatagataaaatctttcataaggtcaaacaaaatgtggttgagaatatagttgacccttgaacaatgtgggggttggggtactaaccccctgcacagtcaaaaatccatgtataacttttgactccctccaaattcaagtactaatgacctattgttgatcagaagccttatcaataacataaacaacaaatattttgtgtatgtattatatgctgtatattttcaataaagtaagctagagaaaggaaaatgttatttatacttttctctgcttcttgggagtacttccagcatcactagtggcactttatacgggtcccaagtatccttcaaagtttatggagagatgaaatgcttatgcagagatgattagcatcatgcagagttttcagtggatgcctgcagcactcgagctcagcacaataacaataggagatggctactaccgttaattttatgcagttgcgatttaatactggatctttacgtttgtttacatttgtcccaactgggaatggtgccatgtatggttgtaagtatgtaagtttttataaatttcaactttttataatagatttttgtatattttatggtaataaatgataaaatagtctagtatcaacatgtatatgtatatataagtgtgtatacatatatatatatattttttttttttttttttttgagacggagtcttgctgtcgcccaggctggagtgcagtggcgcaatctcagctcactgcaggctctgccccccggggttcacgccattctcctgcctcagcctcccgagtagctgggactacaggcgcccgccacctcgactggctaattttttgtatttttagtagagacggggtttcattgtgttagccaggatggtctcgatctcctgacctcgtgatccacccgccttggcctcccaaagtatatatatatattttttgagacggagtcttgttctgtcacccaggctggagtgcagtggcacaatctgagctcactgcaacttccccctcttgggttcaagcgattctcctgccccagcctcccaagtagctgggattacaggcatgtgccaccacgcccacctaatttttgtagttttagtagagatggggtttcaccatgtttgccaggccggtcttgaactcctgacctcgtgatctgcccgccttggcctcccaaagtgctgggattataagtgtgagccactgcatccggccatctccatatattttttgcattcataacatacctttttcttaatttttttgatatttttaccctatgtggtccatctgacagttttttcaaattgtcataaatttccaaaaaaatctcactatatttattgaaaaaaaactgcatataagtggactcatgcagttcaaacctgtattgttcaagagtcaactgtgtgttttaaagcagattttaacatcaagaaatgatagaaaaatgataagaattaaaagagataaatattcatattagaattgcccatcaggagcttctgagtagctgaacgcatggaggttcctggagagtggctggccccatgccccttcccacatacccttccttatatatgcatctcttccatctggcgtttataagaaaaggtgctgactgctgaattataaggacactgtggtctactagataaaggttgaggagaggggtttgggcttctattgtcttctttccgggccttcatctcctgcttgtgattaagtagtgcatgctgagtggagcaaagtggtggaataggactcttcagcaataatctcctcacagaaacatcaaggtaacaactcgatgcgtgaaattaccttcagaagagttaagaaaacctgaacccatgagcaagactgtgaagcccttttggactgcaaagacgagtaaaaccatagttgcacataaaggggattggttctttatgactgagaccccacccgcaagccactgcagtaccacaggcggaaagtcaccatggacccacggtttttacaccggaaaactctcccgtatggcctgagtgccctctgtggatctccactaattagtagcagagccagcatgagacttgcgtctaacctgggctcagggcgccctctcgtgctaaaaggaaatacaacagccagtcctttcactttctttttgatatggtctctgttgcctaggttggagtgcagtggtgcgatcatagattactgcagtcttgaactcctggctgggctcacacggtcttcccacctcagcctccagagtgggactacaggtgtgtgccactatgcctggctaaattttcgggttttgtgtgtggggtggggaagattggggtattgctatgttgctcaggctgggtctcgaactcctgacctaaagcaatcctccagcctcagcctcctaaagtgctaggttacaagtatgagccaccacactcagccccactcaatttctaaacgagctcactgaaatagagcagtcacaaacaaacccagactgtgaacatgagaataaatacctaattcttcaatgtgtagacagggatgcacatctgcaaagaataagaatagcctaagaaagacagcctcaacaaatgaacaaaaaatcgtgccagtgactaatcctaaagacatgcaggtgaatgatctggtagacaaagaattcaaaatagctattttaagaaaactcaacaaacttttataaaacacagagaaacaattcagaagtttatcaaagaaatttaacagagaaattgaaggaataaaaaaagtcagaaatcctggaactgaaaagtataataaaaaatgacacatgcaatacaagacatcagcaacagaattgatcaggcagaagaaaggatcagcaagctcaaagacaggttatccaaaaatacaatcaggaggggcttcaggatggttgactagatgcatctagtgttcatcccttccatggagaggaaccaaagtagcaagtagataattatactttgaataggtcatctaagagagaacactggaattcaacagagcagtgacaggaagcattgaaagcaagggaggagagagaaataaggcctgtttgcctgggattggctgggagtctggaacagcttcctaatgtggggaaaaggtaagagacccttagtgttcctcattttcaccaaggactcttgcaatcctagccacaggagagcgccttattccttgacagcacagagactagcatagggagttgcctaaagaccgtgtgaaggcattgcaacagagagctcacgctggattctgcaattctcccaagcagctgcagcacagcaccattttgagaacacagcccacacatcctgccctgctatgatggccgtgacttaggcaggagccctgagcagtgatcctgccccacccagcagaggagtgcccatgcattttcacatattccaagaacaaattccactacctacaaccactgctgctgcaggctgctgtggggccaaaacactagtgaaccttgtgctcccaagctacctgcctacagctactccctgagaaagcaaccccaccttcaccaagagcagggctatagcacagctactgctgcaccccaacctgagcattttgctagtgacctcggtatcaccccacccctgcatagcacaaccagcacctcacacaccaccaaggagcctgagggcaggttcacgtagcccagctctacctgcccccagtacccaagcatatcatccaggggcctagggatcacttagccctgtccaccactggtggcacctgagcacctcctggggtctgaggtcaggcccactcaacctgccactactgccacagttagcactcactgcatgcaccacttgagggtctggagactggccatgcgatccatagcagccacaaccaacgccagcacagaccacttgagattcaggttgtttcattgctatgattgccatcaaccatgccactttgctgcccaggaacttgagaacccacccacccatgtgatccatcaataccacttctggcacccaagtaaaccacttggaggcccacaaatcaacctgcctggacctaaaaccagtgcaatcatatgccaccatggtacaccaaagacaagcacactcagcccactgctgccaccattggggcctgaagacaggcctacctggcatcccacttctcagaaaaacttcaccacagcctccactaataaccacaccctaagccactgagaaaatcacaaatatcactgatgctgtttagaatcttatacagaggctactacattcaccgagaatcaaaaccgaagtgctctacccaagcaacaccacagatacatcttcaggaaaaagttctttcctacaaaagcaaattttaaaaattggaaaaagtgattattacaccagatgtgcagatatcaatgtaaggacacaggaaacatgaaaaatcaaggaactatgacactccaaaggagcacaataattctgtagcaagagatccaaataaaaaaaatttaagatgggtacaaaaaaatagaaagaatgaataagacctgctatttgatagcacaacatggtgactatagttaataataacttaattgtacattctaaaataaagagtgtaattggattgttaataactcaaaggataagtgcttgagggtatacatacctcattctccatgatgtgtttgtttcacatcacatgcctgtatcaaaacatctcatgtgttccataaatatatacacctactatgtatccacaaaataaaaaaatcatagtttacaagcaaaacagtatatgtgaccattggtttttaagtaaactggccaacatctctttaaaaatttatgaaatcctggaaaaataattccaaattttgatactaaataaactcagtgagatacaagagaattctgaaaaaaatacaaagaacacagaaaaacaattgaggctatgaaagagaaatttacccaagagatagatatcaaaaaagaaccaaacaaaaattctggaaccaaagaattcattgaatgaaatacaaaatagatttgaaaggttcaacaatagaccggaccaagcagaagagtatcagaactgaaatacagatcttttgaaataacccaatcagacaaaaataaagaaaaaagaattttaaaaaatgagcaaagatttcatgacatattaggcactataaagtgaccaaatatttgaatcttcagtgtcccagaaggcaaagagaaaatgaagaggttagaaagcctatttaatgaaatattagatgaaaaatttccaagtctaccaagagatttagacatctagataaagaaggctcaaaaatacccaaataaatacaatgcaaaaaggtcttctccagggcacattatagtcaaactatcaaaagtcaaagaaaaaaatttaaaaatagcaagagaaaagcatatagtcacctgtaaaggagccgctatcagactaactgtgaatttctcagcagaaactttacaagccaggagagaatgagagagagagaaaaaaaaaaaaaaacacctgccagccaaggatactgtacacagcaaaattatccttcataaatgaaagagagagaaaaatattttcagacaaaaaaaaactgaggaaattcattgcaacctgatctgctttacaggaaatgctaaagggagtttttcaaactgaaagaaaaaggtcctaatgtgtaacatgaaaacatctgaaggtataaaacccacaggtaaaagtaagtatcccgacaaattcagaattctctaacatggtaattgtagaacataaatcacttatatccttagtaggaagattaaaaaacaaaacagataaaaataattaccataacctgttaaagaataagcaatataaaaagatgtaaatgatgacatcaaaaacacaaaatttgggagtcgattttttaaaaaattttcttgcaatcaaaattaagttgttatcagttcaaactaacttgttataactataaggtattctgtgtaagcctcatggtaattacaaagcaaaaatttttataatagatacactaaaaataaaaagcaagggattaaaacatactgatagaagaatcacttaaccacaagggaagagattaagagaggaagaaaggaacaaaggatctacacaacaactagaaaacaagtaaaaatatggcactaccaagttcttacctatcaaaaattaccttgaatacaaatgggttaaattctccaactaaaagacatagagtgtttggttttttgttcttgcgatagtttactgagaatgatgatttccaatttcctccatgtccctacaaaggacatgaactcatcattttttatggctgcatagtattccatggtgtatatgtgccacattttcttaatccagtctatcattgttggacatttggaccgcatattctcactcataggtgggaattgaacaatgagatcacatggacacaggaaggggaatatcacactctgggaactgttgtggggtggggggaagggggagggatagcattaggagatatacctaatgctagatgacgagttagtgggtgcagtgcaccagcatggcacatgtatacatatgtaactaacctgcacaatgtgcacatgtaccctaaaacttaaagtataataaaaataaaaataaaaaaatttaaaaaaagacatagggtggctgaatgaatttttttttaaaaaaagatctaactacatactgcctaagagaaagactttacctgtaaggacacacatagactgaaagcgaagggatagaaacagatattccatgcacatgtaaacaaaaagaaagcaggaatagctatacttatatctgataaaatagacttcaagtcaaaaactataaaaagagacaaacagccagacgtggtggctcatgcctgtaatttcagcactttgggaggctgaggcgggtggatcacctgaagtcagaagttcgagaccagcctggccaaatggcgaaactccatctctactaaaaatacaaaaattaaccaagcatggtggcaggcgcctgtagtcccagctactcgggaggctgaggcaggagaatggcatgaacccgggaggcggagcttgcagtgagccgacattgcaccgctgcactccagcctgggcacacagcgagaatctgtcaaaaaaaaattgacaaacaaggccattatataatagtaaagaagttaatacaacaggagaatgtaacaagcataaatatatatacacccaacattggagcacctaaatatattaatgtttgatctttgtattttctagtctcattaaaagtaagggcaaaaactacaattacttttgcaccaacctaatataaagcaaacattaatagaccaagggggaaatgaagacagcaatgaaataatagtagaaaactttaacaccccactttcaccaatggacagatcatccagacaaaatatcaacaaagaaacactggacttgaactgcactgtagaccaaatagagcaaacagacatttacggaacattccatccaacagctacacagttcacattcttctcaactgcacatggaacattctccaggagattatacattaggccacaaagcaagtcttaactaacttttttaaaatgaagtatttttttcctgccaataatggaataaaactataaatcaacaacaggaggaacaactgtacaaatacatggaaattaaagaacatgcccctaaacaaacaatgggtcaatgaagaaattaaaggagaagttaaaaaatttcttgaaacaaatgaaaatggaaacataacatgccaaaacttatgggatacagcaaaagtagtccttaaagaaaagtttatagcaataaatgcctacatcaaaaaaaaatctcaaataaacaacctaatgatgcatctcatggaactagaaaaacaagaacaaacaaaaccccaaattattagaagaaatgaatgaatacagatgagagcacaaataatcaaaatagaaactaaaaaatacaaaagatcagtataatgagttagttagttctttgaaaagataaaaaaaagtcaataaacttttagccagactaagtgataataaagaagaaaaacagaaataaatcagacatgaaaaaggagacattacaactgataacacagaaatacaaagaattataagaaactactatgaacaactataagccaacaaattgaaaagcctagaagaaatggataaattcctggacacatacaacctaccaaggttgaatcaagaaaaaatggaaattttgaacaaatcaacaatgagcaacaagattgaagcaaaaatacaaagtctcccatcaaagaaaagttcagtacccaatggcttcactgctgaattctaccaaacatctaaagaactaataccaattcttcacaaactattcaaaaaattgaaaaggaagaaactcttccaaaattattttaggaggataatgatcattatcctgatcccaaaaccagacaaaagcacaataacaacaaacaactacaggccaatatcctcaacaaaatactagaaatagaattcaacagcacattaaaagatcatttaccatgatcaggtgggatttatcccagtgatgtaaggatggtttaacatatgcaaattaagaatgaaggacaaaaattatattatcattttaatagacacagtaaaggcatttgacaaaattcaatatcccttcatgataaaaactctcaacaaagtatagaaggagcatacctatatgataaacctacaaacaagatgaaactgagtggggaaaagttgaaagcttttcctttaagaactggaataagacaagcatatccaccctcaccacttctattcaacacagtactggaagtcctagccagagcaattaggcaagacatccaaattggaaagaaggaagtcaaattgtccctgtttggccaggctcaatggcttatgcctgtaatcccagaactttgggaggccaaggcgggcagatcacttgatgtccagagttcgagaccagcctggcaatatggtgaaaccccatctctactaaaaatacacacacacacacacacacacacacatgctagccagacatggtggtgcgctcctgtagtcccagctactcgagaggctgaagcaggagaatcactagaaccccagaggcggagcttgtggtgagccaagatcgcaccactgcactgcagcctgggcaacagagtgaaacactgtctcgaaacaaaaacaaaaacaaacaaaacaaattgtccctgtttgcagaagacatgatcttatatatagaaaactgccaaaactacaccaaaaaactgttagagctagtaaatgaatgtagtaaacttgtagtctacaaaatcaacatacaataattgatagcatgtctatatgccaacagtgaacaatctgaaaaagcaatcaagaaagcaatcacgtttacaatagctacaaaaaatgtccagaaataaattaaccaaggaagtgaaagatctctataatgaaaactataaaatattgatgaaagaaattgaataagacacaaataaatggaaagatatttcatgttcatggattgaagaattaatattattaaagccaaagcaatctacagattcaatgcaattcctatcaaaattccaatgtcattcttcacagaaatagaaaaacaatcctaagatttgtgtggaaccacaaaaaatcccaaagagccaaagaagtcttgagcaaaaagaataaacctggaggcatcacactacctgatttcaaattatactacaaagttatagtaaccaaaacagcattgtgttgacataaaaacagacatatagaccaatagaacaaaatagagagcccagaaatacacccaaacatttaaagccaactgattttctacgaagttggcaagaatacatgatgggtaaagaacagtcttttcaataaatggtgctgggaaaactggatatccatatgcaaaagaatgaacctagaccccctatctctcaccacgtatgaaagtcaaataggccaggcacagtggctcatgcctgtaatcccagcactttgggaggccaaggcaggcagatcacttggggtcaggagtttgagaccggcctggccaacatggtgaaaccccgtctttactaaaaatacaaaattagccaggtgtggtggcacacctgtagtcccagcaacttgggaggctgaggcaggagaatcacttgaaccccagaggtggaggctgcagtgagcctagatcgtgctattgcactccagcctgggcaacagagtgagactctgtctcaaaaaaaaaaaaaaaaaaaaaaaaaagaaagacagaaagaaaagaaaagaacaatagattaaggaattaaatttaagacctgaaactctgaaattattagaagaaaacatagtgtaagcatttcatgacatcaatttgggcaagaatttgttagacaagacctcaaaatcatgagtaacaaaagcaaaaataaagaaattggattacatcaaactagaaagcttctgcacagcaaaggaaacaatcaacagagtgaagagacaacctatagaatgggagaaaatatttgcagattatacatctgacaagggattgatatctagaatatataaggaactcaaacaactcaatagcaaaagtccaaataatcctattaaaaatgaacaaaagacctgaatagacatttctccaaaagagacctacaaatggccaacaggtatatgaaaaatgctcaacatcactaaccatcaggaaaattaaaatcaaaactacaatgagatatcacttacccctgttagaatgactattataaaaaagacaaaataacaagtgctagcaaggatgtggagacaaagaaacccttatacactgttggtgggaatataaattagttaagccattagagataatggtatagagatgcctcaaaaattaaaaatagatctatcatattttctagcaatcccactactgggtatataccaaaaagaaatgaaatcagcatgttgaagaaacatctgcatccccatgtttatgacagcattattcacaatagtcaagatataaaatcaacttaaatgcccatcaatggatgaatggataaagaaactgtgatatagatacacaatggaatactattcatccatttaaaaaagatgaaatcctgtcattttcaacaacgtggatgagcctggaggacattatgttaagtgaaataagccaggcagagaaagacaaatactccatgatctcagtcctatgtacaatctttaaaatttgatctcatagtagttgagattagtgattctaggaagataagggggaagtgggagatggggagagattggtcaatgggtacaatgttacaggtagatagaaggaataagttctggtactctattgcacagtagggtgacaatagccaacaataatatattgtatatttcaaatagaagagaggattttgaatggtctcacaacaaagaaatgacaaacatttaaggtgatggatatgataattaccctgatttgaataattacacaatgtatacatgtattgaaacatcacattgtacccataaatttgtagaattatttatgtgtcaataaaaagtaatacagttaaaaaaataaaattgcccattaggataaataaaaagacccacacacaaaattatcattgtggcatttcagagcacagagagaagatacttaaagcttcttctgagaggaacaggacgcatacaaaagaatgggaattagactggcgatataattaagcaatattgtaaaagatctaagggaaaaattatttggaacctagaatttttagtcaaactatgaatcaattttgggggaagaaaaaagacattttcatatatagagggccttaatagtcactgaatgtgtactatagtaaaaccagaaactacataaaagaggaatttgggagattcagcaacccaagagaataatgaagtatgagggggatgttttctccttagttcttttccgtatttttcaataatttgataataaacatgcataattttataattaaaaaggaaattaattttgacaacatgcaagttcctgttctcacataccttatagtggagggacagattgtagtcaaataagcataataatacatgcaaaattacaaactgagcattactctgaaggaaaattacataattctatgtaagcctataatacaggaatctgacctagactggggaatcagagaaggcttccctaagcaagtaccccttgaacttagctttgaaactgggaaaatgaggcaatgtgagatgaagctgttagaggtattaggaatcaaacctattggggccttctagtccttagtagagagtctggactttattctatgtggaatgacagcctccagtgggttttaggctggcggatactacaatcagatctggaatgcagaaatagtacaccagtttctttgtgggtaaaagtcttagaggggagaatatgaccaactgtagggagacctgtaaaaaaagtttatcagtagctcagacgagataatggtaacttggattaagatagtggtagtagtaacagtgaaaaactagatacatttgaaagcttttagagccaaaataggaggcagctgtgcccttgttgttaccagtgtgggatctgaacacatgactacttgggttcaaatactgagcaaattaattaacctctctgggcatccgtttcctctcctgcaagacatggatgataatggtttctacattcatagggttgttatgaggaatgaatgaattaaaacttgtaaaatactttggacagtgcttgacataaaacaagtgctcaatacatattagctattattgattatattgccctggtcagtgtcaaactgcatatgggagatgagaatggtaacaaggataactctcacttgcatattcaaatgcaggatgctgccattcactgttataaaaaactctggaagagaatgaagtgatgaaaattgtaaatttggttttgaacatgtgggttttttgagatatctaggtggagatgttgagaaagtgattggctgtatgagcctggagttccagaagaggtcagcaggggagacagaagaaggagcagtctgagaagtaggagaaaaaaacccacagagatgttggcacagaggccaagggaagagagagttttaaaaacgaatgaatggtcaacaggtgcaaataaagactgaaaaatgtccattggatttagcagcatgatggtgattggtgaccttggcaagagctgttggtttgatagtagcccaatgttcttgataaatttgtttacaagtcaaggtagcaataaagtgtctaaagtcaatttgtccattctgtcctagcaagtgttttccatttcagattctctacttcatagccataggtgtcttattcctactttacaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatggtaatatcttggatctttaaaatgaatattataaatatccagtcctacttttaataaaatttactggacaatgtacaggaatatagtgtgttgctgaaggggacattatagagttactgtattagacctcagccaagatcccctagtttccagcttccagtgtaaagtttttaccttgactataaaagggcttgagtattagtaggactcatggatttttagttaaatgtctgtgatggagaaaagatggcttatggatgattgaggtgggaaaatgaggagaatagtatgcccttggtttctcagccttatcccattaattacgctccaatattatggagagaggaactgcaagttgtagctgaagagattttttttttttttggagaaatctagggaaatgggaaaaaaaggcattgtccagattgcaactgtaagggctccactatatcattagtaatgcccagagcagtaaatagcaaatatgacaggctattgtagagcttgacttcagacaccagacagccagaggcactctgtagatacctggcagtagatgagagacacctgtgaaactgagggcaggtcaggagctagtgaattttagaagtaacatgggattgaaaggactatttggtgggaactttggaaagggtcaaaggttctgtgtaagcaaattaggacgatggtaactacagttttaaattattgttaatgtaactttatttgtaactgctagttgtgcaaattcagattgcatcatcatttcaccccaattttccttacttttgtatttattctgctaactcttaatcttggatcaacctaataaccctctttctctacccctctcgtggccattgaaggctcttagtcagtttgtgctgcaataacagtataccacagaatgggtaatttataatggacagaaatttattggctcacatttctgggggctgggaggtccaatatcaagttgcctttttctgcgtcttaacatggtggaaggcattatatgacaaaagggcaaagaaagggtgagagagagcaagaggagggtgagctcactcctgtgataacaaatccactcccatgaacactttccccagataactgcattagtccattcatgagggtggaacgcttatgacctaaacaccttttatatgttcacctctcaataccatcacgatgataattaaatttcaatatgagtttcggaggggacagacattcaaaccatagcaagagttattggagaaaaatgtcggagaggcctaatcttttatatttaatagcatttctttcttcctattactctcatattaaccttctcctcaggttccttggttgacttagaaaagagaattgatcttgccatgcatccaccattttcctccttatgttctattagtgaccttgtttattgtcttctgtagtgattaagaatagaaatctctcttccccatgtgtcacataatatttatggaattttgacaagaccttagtggacaaaatgtgtcatactgaatgagtaacaggaagttgatgcacaaacaacattcttgcaggcacagaggaataggtcatttacttgtatatgatcattgtcaatcaatcattgtccagttggaccccgattcagtttattttttgttttgtttttctccttttcacagattctatccactaattttaatctttatttttcagaaaaaaatgctttatcttattgaacctcagaccaaacactttgtttttcgatgcagactgagttatgtttaaggctacatgaaccccagactagttgtttgctgctcctaaaaccttccctgttcctcataatcaagtaaacaggtctcccttcttagaagtatttgatcttcaaaattgccctgtggtataaatagggcaggaattattattatccattttacaaagcatgaagatgagactgagaatgttgaatacatttgccatagggtttacaactagtcacaggcagacatgctcttaaaatatatatctccttgattttaagttgtatcttgtcatggttttatgaacttggaacatgtcttaaagtttatatctacactaacatttttcccaataagctgttattaaatcaatgatttgtggcaagaagggatagtgatgtggaaagggggggtacttaggggagagcctggaaggcctaataagagagaaagaagtcataaaagttaaggcaagtgatatggtttggatatttatcttcactgaaatctcatgttgaattgtaatttccaatgctggaggtggggtctggtggcagatgtttggatcatgggggtgaatccctcatggcttgatgctgtcttcatgatatttggtcattcagaagtgtgtggcaacttgcactctctgtcttgctcctgctttcaccatgtgacatgtctcctcccccttcacctacccccatgattgtaagcttcctgagacctccctgaagccaagcagatgccagcaccatgcttcccatatagcctgcagaaacatgagccaattcaatctcttttctttataaattacctagtctctggtatagaacagcctaatatagcaagacactctgacattgtttggtttgtctgactccagatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacaggtaagcactttttgactattggtactctctcttccccatactcaaaaagttcttaccagttattcaaaccaacaaatcctgaagccatgtttaaggttaggtacaggtatggaatcaaatggcaagggtattaacatttggaaactaacatagctgagcatcagagaagcttgtatttttctcactccttgccttgattgaatcatataagctgttttagagttggatttgagcctacctagaatttttcttcccaacctctcatctttttttctcttatacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttggtaagttgaagaaaagatttaaggtcaggtaagaagaaaaagtctggagagttttgagtttctaaaatacctcataattcagccttgtctccaatggacatgatcttttaaaagctataaatgttacacaaataatagctgattgtatgtatttaaagtttgagtatatagaataaaaatttaatgtcacccactaaactcgacactcctttgaaatactgcttagactttgatacatatccttccagatctttctccattaattatgtcatataggagtcagcagactatggcctgtgaaccaaatttggcttgtggcctgcttttgaacagtccatgagcttagatgagattttacatttttaaaatattgcaaagaaaagaaaggaggatgggaggaaggggaggagaaggcggaggagcaagagaatatgtgacagaggctagatagggctcacaaattttagagtacttactatccagccttttccaaaaaatgcttgcttgctcctgatctaggatattaagaatgagtatggtgtaagtaacagaatactcaatggacagtggtttaaataaataagggtttattttcttcacaagaaatttgaagattggtcgttggttccataaattcagccgctgaagaatgtcatgaagaacactggtttttagatatggagttttgttagatactgccaaactgactttcagcaattttgtaccaatttatatcccctaccataagtatatgactgcccttttccccacaccattgccaacaacatatattataaaccttcagaaaattttccaatttgatgagcaaaatgtttatatgttgtcttcatttgcatttccctggttagtggtcaaattgtatattgtttcatgtttgttggctatttgtataactccctctgtgaattgcctgcttgtaaattttgtccagttttctatttggtcagtcatcttttgcttatgtatttgtaaaaggtctttatagattatggatattgacacattgttatttatctttcaaatgttttcctcacattgtcacttgtactttaactcctttatgatattttttgtccttcaaagatttttcatctttatatagtcaaaacctcctatcttttatcaatcttttcatttatatgtctctggatctttttcacttatgttttctgcctgagaatgtctttgccacccccaagacactacaaaaatagtctatattttattctcttacttgtatagctttatttttacagtgagcaatctaattgccctggaagttacttttgaatgtagtgcataattcaaatagaaattttcccaaatggcagctgacacaaccaatccttttttcattaatttgaaaatgtcttctttatcatatactaaattgctaaaatctgggatttttaattctccttaactaatctgttaccaccctgttttaatgacttcaactttgtgatatgtttgatatctgtatgacatcttctttcattgtacttcttcaaaatttttattagctattattgtacaatttttcttcataaattttgtgtacgtattttttctatttttcattttttgaagattgtataattttattttttattcattaatttttaaaatgcataatgacacaataattttacatatttatagggtactttttgtgtattttgagttacttttactggctaatttaaaaatagataaacaagagcatgcaataaaatgtaaattttcctccctcttggacttccaaccccatagtctgacagacagtcattgctgtgggtttgtatactcccctccagaagtagtgcatacatgtacaaatgtgtgtgtgtatgtgtgtgtgtgtgtgcatttcacacaaaaacaagagcagtgtaaattggtctgtaccttgatttttaaaaggtaacaatatattttgaattagccaggcatggtggcacatgcctgtagtcccagctactctggaggctgaggcaggagaatcgctcgaatctgggaggcggaggttgcagtgagctgagatcgcaccactgcactccaccctgggcaacagagtgagactctgtctcaaaaaaaaaaaaagtaacaatatattttggatatcatttcatgtcaacatatatagatctaccccattctttgatttattcaggttatactctggataccatgctgaatcctacacttaaacattacctcaaaatggatcaaagataaaatgtaagagctaaaactacaaaattataagaaaacaacaggataaatctttgtgatcttgaattagacaatagtttattggataggacaccaaaaccaacaagcaacaaaagaaaaaccatttgacccagccatcccattactaggtatatacccaaaggaatataaatcatgctgctataaagacacatgcacacgtatgtttattgcggcactactcacaatagcaaagacttggaaccaacccaaatatccaacaatgatagactgattaagaaaatgtggcacatatacaccatggaatactatgcagccataaaaaatgtccccgtttgcagatgacatgattgtatatctagaaaacaccattgtctcagcccaaaatctccttaagctgataagcaacttcagcaaagtctcaggatacaaaatcaatgtgcaaaaatcacaaacattcttatacaccaataacagacagagagccaaatcatgagtgaactcccattcacaattgcttcaaagagaataaaatacctaggaatccaacttacaagggatatgaaggacctcttcaaggagacctacaaaccactgctcaacgaaataaaagaggacacaaacaaatggaagaacattccatgctcatggataggaagaatgactgggttttaagacaagagcagaagtggaagttgcatttttatcctcatatcacacacctcagatctggaggtgggattgatattttcagggttcttcgctgcagcttccatgttattgctcttccattctctctctctctctctctctctctctcgtctctgtctctctctctctctcttgagatagggtctcattctgtcacccaggctggagtgctgtggtgtgatcacagctcactactgcagcctcaacttcctgggctgaagtgatcctcccacctcagcctcccaagtagctggtactataggcatgcaccaccacgcctagctaatttttttattttttgtagagatgaggtctcactgtgttacccaggctggtcttgaagtcctgggctcaaacgatcctcctgcctcagcctcccaaagtgctggcatgagccactgcacctaggcctttgttttcttttaaagctggtgcaatcaggcaataccacctgctacccttgcttaatactgtaatcaactgtcctcttggtcatgcctgctcatgcactgaagattttatctcctgaaacactgtctctttctctattatcagtgaatttaatgcccaaatagtaataaaggctgagaggaagcagtgtcctcaccaggcatctaaatttcaattagtgtgagaaggtgcagagaatacttcctgaagcaattgaaacaatttttaaagaagtggaaaggggcctttagagagaaacctaagtactgtcagccctctacattgtcaactgaagaatcctaagtttgtaaatttggagtggaaagggttgcaggctgggaagtgtagcctctggcagcaaatggaagcaagcactttgaagaaggaaggatgagataagaatttatgctgaatgagttggctaagtatacatatttaacaggttccaggaggagctgtgaatatttatgatggggcacctgcaaccacacatgttacatacattccatgttcactttggggtggagacttaacatttagatgcatgaaaattaggctgtatatgtcaaaagatgaaacagaggacacagaggcagcctctgtaaactggccagagccagtccatggtcagtggtctctcatcaggaagcaatgcttctcggttgttatgataaaactgcacaaagggaggggaatccaccacgtctttagaaaggactggtttatgtttaacccttaagaaagaaagtctaacggcagattagggagggagggaatgtaacaaggcatgcccgatctcccatcccatcatggtcagaaactcagtttttaagccatctctggggtctccttggccgagaaaggggtctcttcagtcgtttggggatgcttaagattttatttttatttttcagtatcactggatttctagtctcatattcaaacaaccattgattgaaagtattcaaaaaacaaccccaaaacaataaaagataataatacaacaataaacaataatacaaagaaacaatacggtaaaacaactatttacatagcatttatgttatattatgtactgtaagaaatctagagacgagttaaagtacatgagaggatgtgcatatgttatatgcaaatactacatcattttgagtaagagacttgagcatcacagattgtggtatctgcaggggtcctggaaccaatcctccatgcatgccaaggaacaatttcatgaaaagaccaaatattttgagttttatctagcctcaaattactataatgtagatagaggccacttttatttatctggagttagaccacagttttcttgttgatcctagtcgttttaggatttgatcttagatctcgcttatactttcagattatatttaagaatcaagcaagcagaccatataacatctaccctcacggaatcactgatgtccgtcctttgtattcaaggagattaccaaaaggtaaatattccctcgatttatagctcttttttacctgtagatacagatgagataaatatcatcaataacaactaaaattatgttggtcctttctccagctgttggccggacctcaagctccagtctaaagttataaaaatcaattataggaatcctcaggtgatgtttcatgtaaattcgtgaagagtcgcctgacatgtttttcctattacctagcggtgatgttcaaatattccacagccaattagattccactgcaattggttccactgcaactactgtaaatgccctaaaatcttgaagctggttcttctggcacttaagataatttttttttctgagtacggttttcagctacattccacacttttggtatctagtgtggtattccacactttgggtaactagtttgatattttcaggattctttgctgcagcttccatgttattgctcttccttgctctctctctctctctctctcaacagggtttcactctcacttttggtatctagtttgatattttcagggttcttcgcatattcatttctaaatagttcacaactccagtttttatttactatattgtttgctgtttaaagatttattttttcttttagtagattggatgttatgtatattctttctattatttaattttggatgaatatttatcaaaataatagatgtgtatgcttaaaactacaaaagggctgcctccctagaggcatccatttttaagaatttctgtttttgatttttggtggttatctctacatctctaaaaagttacttatactgctaactctttgtttttcaactttagacattatatacttactttgttttgtgcttttttccattcaagttgtttcagttttatcagtgttttcagttggattggctatcattagaactttaaaaatatactaaacatcaacttttagtaagatattttccaatcatggattgaaaatatcttttgactccatacttcataaattaaggatattaaaaactgtacccctcacttttcctttccccaaacctttcttttctctactgctgctagccattcctttacttttacaaaactaaacttgataacatttacattttgtgctgtaatttgaaataactcttccttgctttgtctatatattttctctaaagcttaaaaaattaaaaaacagcatttgtattattttagtattttagcaagtttcttttcataaatgttaactgcagaactgggtaatatgctatgattgctctcttttctacagctcaagtgattttactattaagataaaataatatgtggaaggaaaaaagttgatctcatagaagtagagataaaatagtggttactagaggctaaagaggggaaggggagggggaaatagggagacgttggttaatggatgcaaaattccagctagataggaggcataagtcctaatgttctatagcactgtagggtgactgtagtcaacaatgacatctattttcaaatagctagatgagaggatttggaatgttcccaacacaaaggtgtatcctgaagtaagactttgttttcttttattcggaaaagaaatgtaggcttcttcaaccctatttcttaggcctttcagcttcttaatcattctatgtattgcttgctatccaaatcttttattttttttttgagacagcgtctcgctctgtcacccaggctggagtacagtggcacgatcttggctcactgcaacctctgcctcccaggctcaggctatcctcccacttcagcctcctgagtagttgggaccacagacgcacactaccatgcccagctaattttttttattatttttattttttgtagaaatggggtgttaacttgttgcccagactggtgtcgaactcctgagctcaagcgatctgcctgcctcagcctcccaaagtgctggaaccaaatctttttcttcttaaagacattcttgtagtgaatagcattaactacttttcccttgtacatttctattttttgatttcttcttttgtttttctggaagtatattctcaagtaacttctaaatatgtggtacatagagggtgaactttctgaatccttcagtatcacatgatgggcagacagactggttataaaaattttcccgctgggtgcggtggctcacgcctgtaatcccagcactttgggaggccgaggcgggcagatcacttgaggtcaggagttcaagaccagcttggccaacatggtgaaaacccatctctactaaaaatacaaaaaaaatagccgggcattgtggcgtgtgcctgtaatcccagctactcaggaggctgaggcaggagaattgcttgaaactgggaggtgaaggttgcagtgagccaagatcaccccactgcactccagcctgggcaacagagcaagactgcatctcaaaaaaaattccttcccctgttttctaatattcattattgccgataagaattctttatttgcatttctttatggaagaatggcatagtgacagagttctggggagattttgaatgtgtgtcccgaaatttggaggcatacgtggatagttactggtaacctgcttttccatggagaattttgaaggctgtaatgcccataatagtgggcaagaagagagggcaagagtggagcagtttaccttcctgctgtttgacatgagtttattctgtaacaagtgaatactgttgaaagtagctgggctttatcccttttgaagatattctacccaagaaggcagttaggcaggctgaggggatagcagaaccaatagagtcttggatatatcactggaagtaagaagagctgatggggagaggagagttgcagaaggatagctgaaagaaacatctctcatgtcatggaactatgtaatgctgaggtccccatggtaactctaaagaaaccatacatgtgtcctatgaaaagaccagcatttgggcacctcccacacagagaacattgatgaccaaatagtgttgtcaaagatagagcagcaggacctgttaaacaagagtctgtttgccctttcttctattacctaccctccctcacccccagctcctggaaaagggaagagaaggctcagaaatattgaaagaacatactacaccattccctttctttctttctttcttttttttttttttttggagacagagtctcgctctatcccccaggctggagtgcattggcatgatatcggctcaacctctgcctcccaggttcaagcaattctcatgcctcagcctcccaagtagctgggattacaagtgcctgccaccacacctggctaatttttgtatttttagtagagatggcgtttcaccatgttgaccaggctggtctcgaactcctcacctcaacaccattccctttctatggatcctctaaccataggtcaggcataacttactgaggtgaggaagagcttagaatgaatataaaattaaaattttgatttagattgtatcttcaggtatgaaacatacccagaatgagacttaattactaaaatcagttcttgtcctgaggacccattaccctgagggcagatctcagttcttgctccctttcctcacagaagtcagagactacaccttaaaactccaatgccaagctctttggcatatattcaggcctgacactttcacagtcaaccggataatcaattacagctttttactttttaaaaaaattgtttgaatcttaaaattataataggtgcgactttagcttccacttgctcagaaacttcatatgtacatacagatttgtagaacccttgcaacaacaacatgattatcaatatgtggcttgttgtactctaattgagctatttatggttttgcttgtgggtaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccaggtgagttcttgcctttccaagtgctgggtttcattctcagtgtatgtccccttataacctgaagaaaatataatggtttgcaatataggtcagtaaaagaaatgagcttagcttttactaaatttgagtttcacgtagtaaacgtgcctgctggatggataggccatagaatgtaggccctagatttttcctatagtactcattcccagtctgggatttagctctctctagctgatcctccccatttttatatgtccaattaccacctattttcagatgacccacagatttatatctacagcctagatttcttccatggacatctcattatgggtgactcaaaagtacctcaaaattaacatgtctgcagcatgtagcactgttgcaggaagtcagggaccccgaacagagggactggctgaagccacggcagaagaacataaattgtgaagatttcgtggacatttattagttccccaaattaatacttttataatttcttacgcctgtctttactgcgatctctgaacataaattgtgaagatttcatggacatttatcacttccccaaccaatactcttataatttcctatgcctgtctttactttaatctcttaatcctgtcatcttcataagctgaggatgtatgttgcctcaagaccctgtgatgattgcgttatctgcacaaattgtttgtaaagcttgtgtgtttgaacaatatgaaatctgggcaccttgaaaagaacaggataacagcgatttccagggaacaagggagataaccataaagtctgactgcctgcagggccaggcagaacagagtcatatttctcttcttgcaaaagcgaataggagaaatatcactgaattctttttctcagcaaggaacagccctgggaaaagaatgcattcccagggggaggcctctaaaatggccgctctgggagtgtttatcttatgcagttgaagataagggataaaatatgccctggtctcctgcagtgcccccaggcttgctaggattaggaaattccagcctggtgaattctagtcagaccagttctctgctcttgaaccctgtttcctgttaagatgtttatcaatgacaatgcatgcacagcaggacatggaacctcattagtaattctaatttcgccctaccttgtgatcttgctctgtccctatttgccttgtgatattttattgcctttgaatcatgtgatctttgtgacccacaccctattcgtacactccctcccctttgaaaatcactaataaaaacttgctggttttgcggcttgggggcatcacagaacctgccgacatgtgatgtcacccctggagacccagctgtaaaatttctctcttttgtactctttctctttatttcccagaccggccgacacttaggtaaaatagaaaagaacctatgttgaaatattgggggctagttcccacaatatagcacagtgcatctcacttagtaagagcttaataggctacgtgcggtggctcacgcctgtaatctcagcactttgggaggccgagacaggaggattgcttgagctcaggatttcaagaccatcctgggcaaaatagtaagaccttgtctacaaaaaaaaaaaaaaaaaaaaaaaattagctgggcatggtggtgtgtgcctgtagtcccacctactcaggaggctgaggtgggaagatagcttgagcccaggaggtcgaggctgcagtgagcctggatgacaaagcgacaccctgtctcaaaaaaaaaaaaaaaaaaaaaaaaaaaagcttaataaatacttttgggcaaaacatagggaaagatataaaatatttcaaaatatggctagaatttggaccatttctactgctttaaaaaataaagctaaattctctgaacaagaaaagcttagttcttcacaaaaactcattgctcggccccagaataactcagtgccatattgctgaggcttgactacatgtccatttgattatatttatgatacataagatccctactagtctgaaaacatttcatatgtttagagagtaaagtatatgaactttggtgccaataaaacacatggcacataaactcagagaagtataaattttgccaagtacttgtcctgaccgatttttcctaactatagttttttcgtcacttttgggaagagaactgaaatattattctatattctccaatctcctctcttcagtattttggtttatatagctataggttataaaaaatgaggtttatacatattagtgaggtttacatatgaaatcttagcagatccaattagcaagcgactaattcataaatctggttcatatacaaaatgctcttctgaaaaaaatttgaatgttttaaacagaaaatttaaggtattagtgttgtttgacatttttgtggttcaccttatctttcttatttgatttctgtttttctatttttaattttttatagccttgtggaaggtcagttgctagatggaagtttaggaaagtcagtatctcatttgacttaactaacttaagaaaggcactgaataaccacttggttctttaaggagttaaatcttctaatctgaacatgaagagaataaggctacagactgtaccaaataaatcagctagcatatggccttgggtgcagaaaaaactaagttcagtgggatcagtcaccctcttgtcctggggacacatttgttgtaagcatatactcactgctcatagcacccaccctcaactcccaagccctggtacatgcctaagaggaaatggaattaaaccaatggattagatatatcacatgcatgccatcgctttcatcatagactgctagctcctacctgacaacatcagtagcatttctttacccctttcaatatatgtaattaacagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagtgagtaaagcagcacttaagtccagtgggtggtgaataaagaaaaattgatgtaatcaaagtgatgtccagataatgaatgaattgtatgtgcacataaatttaacaattatgttacctataaatgtataatttttactcaaacacacgtgatcatataacccatattttaaaaatccagtcaccattttttcctttcaatatttacttgatttccctctcccttttaattccctatctccttctatattacatcttttcaccaaccattccatgcccaggtaacatattttaagacatattttctctataattatataatcatatataaacacatacatacattgtattagtcttctagtgctgccataacaaagtactgcagactgggtggcttaaccagcagatatctattgtcttacaactctggaggcttgagatcaggatgtgggcaacgttggtttcttctgaggcttctctccttgtcttgtagatggctttctcccttgtcttcacatggtttctcctttatatatctttgtcctaatctcctcttctaataaagataccagtattgttgggctagggcccaccgtaatgaccttattttaactaactacctatttaaaaacactatctccaggtatagtcacatgctgaggtactggggtttaggactgcaaggtataaatttgggatgggggaacacaattcagcccattgcatacatacacatgtgtatatatttatatataccacaaatctgaatggtcaaaaatatggtaaaaaattccaattgcactatcctacagggaaatgcgaaatagaataacaataggatagcactttatacccatcaaactgccaaaattataattactagtgggcttgtggataaaagagtgttctcatgctatattagtggataagtagtatagtcttttcaaaaccaatatatgccttttgaaattctgattattaagatgtttaagatggagtgagccacatttccctgtgtgtcccactggatgcaactaaaaatcctgaacaggccgggcacagtggctcacgcctgtaatcccagcactttgggaggccgaggcaggcggatcacgaggtcaggagatcgagaccatcctggctaacatagtgaaaccccgtctctactaaaaatacaaaaaattagccgggcatggtggcggccgcctgtagtcccagctactcaggaggctgaggcaggagaatggcgtgaacccggaaggcggagactgcagtgagccaagatcgtgccactgcactccaggccggcgacagagtgagactccgtttcaaaaaaaaaaaaaaaaaatcctgaacgaaatgcatgggaaccttgaaaagttataatgtgagttatactcacctaccagaatgtggcatatgttacaattctatgcccctcctctcaaagctttagccctttaactttgggttgagcctcatatttagcttgaatttctagtaatagtgatatattattctccagagttaaagtcctttactatccattattctaaaaattttaaggttgtttagtcctttgagttgcatttttattttttacatagttcagggtattgctttccttctgaaggattcagatttcacatttgtgcaagagtctaatgcttagtatttaattctagtggcacagagctttttcttttctccctcttctctccagcctcatggctttggtttagaattccttcagcctgatagaatattgtattttataatttccttattgtgctatttactagatatttgttcttctatttttttctattcataatttctccctttcccaccacatctttttccaagtaggatgtgcacttgccacagtatctggacagttaaactgtctcattttcttggagacggtgatgaaaactagagagatatagtgacataagcagagccagaaaacaatttcactgaagatgatatatattttttttcctctgggatttctaatatagcttttggtggagataagagtctggaattgagaaagaagagattggaattgagaaaaagagtctgagaaagcacagggagagacacaaaggcagagaccaagagacacaggggaaggatcttcagaggaagagtccagggagaaagatgctaagacagagggataagaaaagaagaaaaaaaaggaccaggaggagagagacccaaaccataaatcactcctatttccattagcagtaaaattgataatctattttcatacaatgaaataccatgtgacaatgaagattcacaaaaataaagctatacacaacaatatgaataagtatcacaaagacaatttttagtaaaatggtaagtgtcaaaagaatatatacagtattatattatttacataaagttcaaaaatgggcaaaattaacttatatagtttagggatacagaggaagaaaagtataaaggttagtaaggacatgattataataaaagacaagatagtggctacctcttagaaagagttcatttgagaataaacacatgtgttttgtggggatagcagcaatattgtatttcatgacctagatgtttgttttataattttgtgttttaaaaaattgtaggatttatgatttatttcgtagatggatcctacaaatgatagggaaattgcagtaggaatgaagaggaaggaacatgtacaggatttgtttagaagatagaaggcacatgattttgtaaataattagctatgtttggtaaaggactaagaggattcaaagatgattaccaaatttctgatatgggtaactagaagaagagtgagacaaaatggaagaaagtgtatttaaagaaatgatagcaaaaactttccaaatctggagaaagatgtaaatatccacgtacaagaagctcaaagatctctagtcagattagattcaaacaagactatatgaagacacgttacaatcaaactgtcaaatatcaaagacaaagagagaatcctgaaagcaacaacaaaaaagaagcaaaccacatacaaggaaattccaataaggcagaaactttacaggtcagaagagggtgggatgatatattccgagtactgggaaaactttacctagaaaatgtttccttcagaaatgcagagagataaagactttgccacacaattccagttagacaagagaaataaattaaagacatctattgtacactatggtgactacagttaataaattacccattccaatatatacatatataaacattgtgatgtacatcataatatattctatttttccctgtcaattaaaaaataaatttaaaaagattggatagagaagaatcagccattctagtaattaagcctgaggaagcttacattccagtgatttcagataaccattatgcaagttaaggaataaactggataggatgatattaaaaaaacaaaaccaccaatgagatacaccagaatggctaaaattaaaaaggctgtccataccaagtattggtaaagatgtagagtaatgagaactctcataaatttctggtcaggaaatccaaacatcgaaagccaaacatcggcataccctattgactcaggaaatccactcctagtatacacctgttatgtcctgaatcatgtcccctagaattaatatgctgaagccctaacactagtatttcagaatgtgactgtatttggagatagggtctttaaggggtttattaagttaaaatgaggttgttacaatgggccctaatccaatatgactagtgtccttataagaagaggaaatgtgggccaggcacagtggctcacgcctgtaatcccagcattttgggaggccaaggcgggcggatcacgaggtcaagagatcgagaccatcctggccaacatggtgaaaccccatctctactgaaaatacaaaaattagctggacatggtggcgagctcctgtagtcccagctactcgggagactgaggcagaagattgcttgaacccaggaggtggaggttgcagtgagcagagatcacgccactgcactccagactggcagacagaccgagactccatttgaaaaaaaaaaagaagaggaaatgtgtacacacagagacaccagggatgcatattcacagaggaaagaccaagccaaggagaggtgtcagtaaaaaccaaacctgccaataccttgatcttggaattttagtgttcaaaactgtgagaaaacacattcctgttatttacacctcccagtctgtggtatattgttatggcaaccctagccactagtacagcacccaaaagtagtgtgtacatatttcacaaaagacatgtaactatttaatccatgtggagtgtcaaaaggcaaaaatacaacaaatgtattttaaagattgtaattggcttttatacatgattctagaatcagatagccctcagaaccaaatacagaacagcagccagcaacatagtatggatagaaattggaagtgaggtttagagacagcttaattgattacagttgggcatttttgccttatttgaagctgttagtcgcctgcaattgatggaagttcagctgctataatcggctgagactgagctgtttgttataaaagcatattcctaaattaggctttcagttagttcatcaactaagccaggctgcaactttgttgtgcaaggactcaagtgcaaaggtacccttaggcaaaattcagattaatttaaaaggactttacttttgttagttatgtgaaatgaagtggaatctattttttccaagtggatagtcatattttctattatcatttaccaactagctgatttttttcctgtactggttggagatgctgcctttattatatattaagtttcaacttattatatattaagtttccgcttacatcttgtcagtttctggactccatattttgtttgatatatttatctattctgcattaagactgcatttttaattataatagctttataatatctcaatgttgtataggaaaaaaacttcaattattaattagttatactaagccaatgtctaagtattgcttagtggtttgtgggcaaccatcttacacagtacctagtaacagagtagacaagtgtttattgaatggatggatgaatggatgtgtggaagaggctttcagaaacaattcccttcatagactaaggccaatgttacttttgcttagctctttagtttgaaataatttaaaatgtacagaaaagttacaagaataatacatggaacttgcacacaccctttacccagattcacaaatgtttaacattttgcaattttgtttttcattttcttttctttatatacacacttctgttacttattttctatttgaaaattagttgcagacatcacatccctttacctctcaatactttagtacacatttcctgtgaataaagatatcttttacataacagacacttcaaattgataaagcacatttccataatttacaactggtattccagttgtatcaaccaatgctgtcatttatagcattttcttctttgaagtacagggatctagtacaagtaactacttgtcctgcttctttcatttccttgaatctggaccttcatcagatggtaactttaagcacccaaaggtttttttctggtttctcctctgtgtagtttaagaccatgcaaacatcttgctactcatcaaaatgccccccatataacatccaaattaatctttatcatgatggtttatgactgtctcctcacattgggattggggcccaactgattattaacaatctacttttttggaagatataatatctcttcctgggaataagataatgggcataacatataataattcctaattgtatcatgacaatcacaatccaaaatactaaatctgtgatgtgtctaaatctcttttccccattgtttttgcaggcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggttagttattatatttttcttgtaccaacagctgtgaatgcttcactagccattcgtatgctcttttgcccactagctcacatgctgtcatttatagcattttcttccttgaggtacagggatctagtttctcctctgagtagttattattttcacccttgcaactaataaacagtttgaaggatcacgtagtagttctatttttagttttttgaggaacctccttactcttttccacagtatttgtacttatttacactcccaccaacagtgtacaagcattccccttttgccacatcctcaccagcattttttaattattttgtctttttgataaaagccatttaactggagtgaaatatctcattgtgcttttggtttgcatttctctggtaattagtgatgttgagcagtttttcatatacttgttggccatttgtatgtcttctttttttttttttttttttttttttcagacggagtctcgctctgtagcccaggctggagtgcggtggcacgatctcggctcactgcaagctccgccacccgggttcacgccattctcctgcctcagcctcccgagtagctgggactacaggtgcccgccaccacacccagctaattttttgtatttttagtagagacagggtttcaccgtgttagccaggatggtctcgatttcctgacctcgtgatccacccgcctcggcctcccaaagtgctgggattacaggcgtgagccaccgtgcccagcctgaatgtcttcttttgagaaatgtctattcagatctttgtccatttttaatagggttctttgttttttttgctattgactagagtttcttatatattctggttattaatgccctctcagttgtatagtttgcaaatatttcatcccatcctataaattgtctcttcactttgttaattgtttcctttgctgtccagaagctttatggcttgatataatcccatttgtctacttttgctttagtcccctgtgcttttgaggtcttacctgcaaaatctttcccagaccaatgtcctggcgcattcccccaatgttttcttccagtagtttcatactttcaggttgtatattttagtctctaatccattttgatttgatttttgtatatagtgagagataggggtatagtttcattcttctgcatgtggatatccagttttcccacaccatttattgaagagactattctttcaccagtgcgtgttcttggcactttgtcaaaggtgagttggctataaatgtgtggatttatttctgggttttctgtcgtgttccactggcatatatttctggttttatgccagtaccgtgctgtttttgttactacagctttgtagtatagtttcaagtcaagtagtgtcatgcctccagctttgttcattttgctccagattatttagctgtttggagtcttttgtggttccacacaaattttaagattcttttttctatttctgtgaaaaacttcactggcatttggataggtattacattaaatctggtagcattgatattttaacaatattagtttttccagcccattaaaatgggatagataccttttcagttttttgtgtgttcttcaattccctttatcagtattttagttttcattatagagatatctcagctctttggtttaatttattccaatatatttatttttattatagctattgtaaatgatttttaaaaaatttctttttaggttgttagctcttggtatatagaaatgctactgatttttgcatgttggttttgtatcctgcaactttactgaatttgtttatcagttctaatagttttttgatggagtctttagttttttgtgaaatataagattatgtcatctataaacaaggagaatttgacttcttcctttccaatttgggtaccctttatttctttctcttgcttacttgttctggcttggacttccaggactacattttatagaattggtgaaagtgggcatccttatcttgtttcagatcttaaaggaaaggcttttggttttccacatttggtatgatattagccgtagtttgtcatatatggcatttattgttttgaggtaagctttctatacccagtttgtttagagttttctcatgaagggatgttgaatttaatctttttggcatcaattgaaatgatcatttgtttttgtccttcattctgttgatatgatgtatcacattgattcatttccatatgttgaaccatccttgcatccctgggatgaatcccccttgatcatgatgaatgatcttttactgtgttgttgaatttggtttgctagtagttcgttgaggatttttgcatcaatgttcatcagagatattggcctgtagtttctttttgtgtatgtgtgtgtctttgtctggtttggtttcagggtaatactggccttgtggaatcagtttggaagtatttttcccccttgatttttgggatagtttgtgaagagctggtattagttctttttttttattattatacattaagttttagggtacatgtgcacaatgtgcaggttagttacatatgtatacatgtgccatgctggtgtgctgtacccattaactcgtcatttagcattaggtatatcgcctaatgctatccctctccccttcccccaccccacaacagtccccagagtgtgatgttccccttcctgtgtccatgtgttctcattgttcaattcccacctatgagtgagaatatgcagtgtttggttttttgttcttgcgatcgtttactgagaatgatgatttccaatttcatccatgtccctacaaaggacatgaactcatcatttttatggcggcatagtattccatggtgtatatgtgccacattttcttactccagtctatcattgttggacatttgggttggttccaagtctttgctattgtgaatactgccgctataaacatacgtgtgcatgtgtctctatagcagcatgatttatagtcctttgggtatatacccagtaatgggatggctgggtcaaatggtatttctagttctagatccctgaggaatcgccacactgacttccacaatggttgaactagtttacagtcccaccaacattgtaaaagtgttcctatttctccacatcctctccagcacctgttgtttcctgactttttaatgatcgccattctaactggtgtgagatggtatctcactgtggttttgatttgcatttctctgatggccagtgatggtgagcattttttcatgtgttttttggctgcataaatgtcttcttttgtgaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagttcccatttgtcaattttggcttttgttgccattgcttttggtgttttagacatgaagtccttgcacatgcctatgtcctgaatggtattgcctaggttttcttctagggtttttatggttttaggtctaacgtttaagtctttaatccatcttgaattaattttagtataaggtgtaaggaagggttccagtttcagctttctacatatggctagccagttttcccagcaccatttattaaatagggaatcctttccccactgcttatttttctcaggcttgtcaaagatcaggtagttgtagatgcgtggcgttatttctgagggctctgttctgttccattggtctatatctctgttttggtaccagtaccatgctgttttggttactgtagccttgtagcatagtttgaagtcagggagcgtgatgcctccagctttgttcattaggcttaggattgacttggcgatgcgggctcttttttggtttcatatgaactttaaagtagttttttccaattctgtgaagaaagtcattggtagcttgatggggatggcattgaatctataaattacattgggcagtatggccattttcatgatattgattcttcctacccatgagcatggaatagtcttccatttgtttgtatcctcttttatttccttgagcagtggtttgtagttctccttgaagaggtccttcacatccgttgtaagttgtattcctaggtattttattctctttgaagcaattgtgaatgggagttcgcttatgatttggctctctgtttgcctgttattggtgtataagaatgcttgtgatttttgtacattgattttgtatcctgaggctttgctgaagttgcttatcagcttaaggagattttgggctgagacaatggggttttctagatatacaatcctgacatctgcaaacagggacaatttgacttcctcttttcctaattgaatacactttatttccttctcctgcctaattgccctggccagaacttccaacactatgttgaataggaaaggtgagagaaggcatccctgtcttgtgccagttttcaaagggaatgcttccagtttttgcccattcagtatgatattggctgtgggtttgccatagatagctcttattattttgagatacgtcccatcaataccaaatttattgagagtttttagcatgaagggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttttgtctctgcccggctttggtatcaggatgatgctggcctcataaaatgagttcaggaggattccctctttttctattgattggaatagtttcagaaggaatggtaccaattcctccttctacctctggtagaatttggctgtgaatccatctggtcctggactcttttcggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggattggtggtgatatcccctttatcattttttattgcatctatttgattcttctctcttttcttctttattagtcttgctagcggtctatcaattctgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccatctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttgttttacatttgctgaggagagctttacttccaactatgtggtcaattttggaataggtgtggtgtggtgctgaaaaaaatgtatattctgttgatttggggtggagagttctgtggatgtctattaggtccgcttggtgcagagctgagttcaattcctgagtatccttgttaactttctgtctcgttgatctgtctaatgttgacagtggggtgttaaagtctcccattattattgtgtgggagtctaagtctctttgtaggtcactcaggacttgctttatgaaactgggtgctcctgtattgggtgcatatatatttaggatagttagctcttcttgttgaattgatccctttaccattatgtaatggccttctttgtctcttttgatctttgttggtttaaagtctgttctatcagagactaggattgcaacccctgcctttttttgttttccacttgcttggtagatcttcctccatccttttattttgaggctatgtgtgtttctgcacgtgagatgggtttcctgaatacagcacactgatgggtcttgactctttatccaatttgccagtctgtgtcttttaattggagcatttagtccatttacatttaaagttaatattgttatgtgtgaatttgatcttgtcattttgatgttagctggttattttgctcgttagttgattcagtttcttcctagcattgatggtctttacaatttggcatgattttgcagtggctggtactggttgctcctttccatgtttagtgcttccttcagaagctctcttaggtcaggcctggtggtgacaaaatctctcagcatttgcttgtctgtaaaggattttatttctccttcacttatgaagcttagtttggctggatatgaaattctgggttgaaaattcttttctttaagaatgttgaatgttggcccccactctcttctggcttgtagagtttctgccgaaagatcagctgttagtctgatgggcttccctttgtgggtaacccgacctttctgtctggctgtccttaacattttttccttcatttcaactttggtgaatctgacaattatatgtcttggagttgctcttctcaaggagtatctttgtggcattctctgtatttcctgaatttgaatgttggcctgccttgctagatttggcaagttctcttggataataccctgcagagtgttttccaacttggttccattctccccatcactttcaggtacaccaatcagttgtagatttggtcttttcacatagtcccgtatttcttggaggcttcgtttgtttctttttattcttttttctctaaacttatcttcacacttcattttattcatttcatcttccattgctgataccctttcttccagttgatcgcattggttactgaggcttgtgcattcatcacatagttctcgtgccgtggttttcagctccatcaggtcctttaaccacttctctgcattggttattctagttgtccattcgtctaattttttttcaaagtttataacttctttgccattggttcgaacttcttcctttagctcggagtagtttgatcttctgaagccttcctctctcaactcatcaaagtcattctccatccagctttgttccattgctggtgaggagctgcattcctttggaggaggggaggtgctctgattcttagagtttttggtttttctgctctgttttttccccatctttgtggttttatctacctttggtctttgatgatggtgacgtacagatgggttttcggtgtggatgtcctttctgtttgttagttttccttctaacagtcaggaccctcagctgcaggtctgttggagtttgctggaggtccactccagaccctgtttgcctgggtatcagcagcagaggctgcagaacagcagatattggtgaactgcaaatgctgctgcctgatcattcctctggaagttttgtctcagaggagtagctggccatgtgaggtgtcagtctgcccctactggggggtgcctcccagttaggctactcaggattcagggacccacttgaggaggcagtctgcccgttctcagatctcaagctgcgtgctgggagaaccactactctcttcaaagctgtcagacagggacatttaagtctgcagaggttattgctgtcttttgtttgtctgtgccctgcccgcagaggtggagcctacagaggcaggcaggcctccttgagctgtggggggctccacccagttcgagcttcccggccgctttgtttacctactcaagcctgagcaatggcgggcacccatcccccagccttgctgccaccttgcagtttgatctcagactgctgtgctagcaatgagcaaggctccatgggcgtaggaccctctgagccaggtgcaggatataatctcctggtgtgccgtttgttaagcccgttggaagagcgcagtattagggtgggagtgacccgattttccaggtgccatctgtcacccctttctttgactaggaaagggaattccctgaccccttgtgcttcctgggtgaggcgatgcctcgccctgcttcggctcacgcacagtgcactgcacccactgtcctgcacccactgtccggcactccccagtaagatgaacccggtacctcagttggaaatgcagaaatcacccgtcttctgcatcacttatgctgggagctgtagactggagctgttcctattcggccatcttggctcccaatgcaaagaccttcaaacaacgtgacttcattttctcactcctaccttttgtgctcttgtcatttatttgaattctacatatattttaaaccccataagacattattattgttttatataatcaatatcatttatatatatatatatatttacacctttcatttctttcattcttttctgcatttcttgcttccatctatgatcattttctttttgtctgaagaaacttctttggaacttccttcagtgtgtgttggctagtaaaaagttctctgtcagtttttggtcagaatgggtctttattttgcctagatacaagtccttggttggatttacatattgtgaatgttttctcccagtctgtggtttgtcttttcactcctttaagggtgcattatggttaatagaagttcttacatttaattaattcttatttttcagttttttatggttaatgccttttgtattctgtttcagaaatttttgcctatcctaagaacatgatgccatccttctatattttctttctacatattttaaatattttcttctagaagtctgattgctgtgttgttcacaattaagtttatgattcatttttaattaattttgatggagtgatgcagataaaagttcatttttccatatggatatttaattgctctagcaccaattgttggaaaaaaataatttcctcactgaattgcactgttgtctttgccatgaatctgatgactgtatcactgtagctttgtttctgtactctatttcaggggtaggttatgatccacaagccaaatttgcagcttgtttttatatggcattgagctaagaatttttttacatttttaaagaattgtcacacaaaacaaaaaaaaagcaaaaaaacaaataaggatatgtatcatggaccatatgtgtctacaaacctaaaatatttactatgttgctttttacagaaaaagtttgccaacccctgatctcttatattccattgacttattggtctatctttgtaccagtaacatactatcttatagtaagttttaatatttgttagtataattcctccaactttgctctctttgatttttatataaattttagaatcatcttgtcaattttatcaataaaaatatcttctgaggttttgatagggattacattgattctgcagatcaatttgggggagcatacctcttgacaatattgagtattcctgtccatgagcatggtttagttatttatttacatcttttaaattttctcttggcaatgtttttgtaaaattttagtgtacaggtcttgcacatttttgtaaagtgtattctttggtatttaatgctattataatattttttatggtatcagtttttgtcaattgtgtttttctagaaatatgtccctttcatctaagttgtttaatttacttgaagtaagttatttgtaatgttcttttatcatccttataatgtctgtactgatgtctccgttttcatacctgatattgttatttatattttatctattttaagtttatcgcctgcacccactaactcgtcatctagcattaggtatatctcccaatgatatccctcgcccctccccctagtgcacatgtaccctaaaacttaaagtataataaaaaaaaaaagtttgtcgcctttgttataggttcatcaaatttactaatcctaccataggatcaaatttttgctttgttcatcaggtcatggaattaaaaaaatttttttgttttgtttattttctatgttgaatttttatttttattttgctttgcatttcatttatttctggtcttttgttattattccaatactttctctggattcagttttctttttcttcttgacttcttgagattaaaacttggttcattgattttcaacatttcttactttttaaaagttcatacaaagcataaatttccctttatatactgctttaaccccatatcacaaattttgatgagtcatatttttattatcattgagtttaaaatattttataaattttacgttatttcttgttttattcatagttattttacagtgttttacttaatttcccaatatatggcgattttctggctctctctctgttgctgatttatttgttttactgtgatcacataacatactctatattatttcaatcatttgaaatttgttgagacttgctatatgcccagtgaataatttaatttgattaatggcccactgcatttgaaacaaatatgtctttgctgttattgggtagagtgtcatatatttgcctattatgtcaagttgctttatcatgtttttaaaatccttataaacttcctgatattttatctgtttcttacagacatggaggaaactgtgacatctctgtgattgttgagtttgttattttgatttttgtatttgttagtaagaatgtttcaaaataaatgaggcaatataaaatcaggtgcttacaactttaaggttgtattcttattaaatcaattctttcatctttgtgaaatgtcctttttgtctgaagtagtacttgttgccttaaacgtctgcattgtctaaaatttatacacctgcactatcatatttattttgcttaatgtttgtgtggtatatatttcccattcttttcttttcaacctatctctatccttatatttacagtgtgtcttttttaacattttctgtagtgcaagtctgttggttaattaattttgtcagtttttgcttctctgaaaagtctttatttctgtttttgaattatatcttcactgtgtatagaattctgggtttgtggttgttgtttttgttttattacattttgttttattggtttttccctcagcactttaaaaatgccgctccattgtttctacttgcatagtttttcacaataagtttgttgtaattcccatttgcattcaactgtacataatgtatctttttaaaaaaatctggatggcttcaagctctttactttgatttttgtgtgtgtgtgtgtgtgtgtgtgtgtgtgtgtgtgtgtgtgttactttggcattctctaggcttattcaatctgtaatttggtatcattaattttgaaaaatatttatcatctgtgtcttcaaatattgcttctaattctttctcttcttctggtattgcatttacatatattatactgttcaattttgtcacacagctcttgaatatgctgttctagtttgttttctaactatttttccttctagttgttcagttttgttgacatttattgacctatttttacttcagtaattgtttcctgggttgttgagttaattgatgaactcatagatgacatacaatttatctttttattcttgtgtcacttgtgcttttgatgtcacatctaggaaggctttgtctagcccaaggccacatttacttccatattttcttctaagagtttgatagttgtagctgttacatatatgtctatgatctagtttgaataaatttttgtgtatggtgtgaagaagaggtctaacctcttttttattttttgcatgtaaacatccagttgtcccggcaccatttgttgaaaatatgattcttttcccattaagtcatcttgacacccttgttgaaaatcaattgaccataaatgtgagagtttatttctgaactctccattctgttccattgacccatacgtcttctataaattcttatagctaattctacattagactttggtttttcagatgtggtcatctcattagattatggtgatatgtttggttacaagttttatcttctccttggcaacattttttttattactgctcttcttttattcgtttttgttgttcctttctctttttgtgagacagggtctcactctgttgcccagggtggagtaagtggtgtgatcatggctcactgcagcctcaacctcctgggctcaagcaatcctcccacctcagcctcccaagtagtgggactacaggcatgcaccatcatgccaggctaacttttttattttttgtagagacagggtcttgctttgttgcccaggctggtcttgaactccaagctcaagcaatcctccaacctcagcttcccaaagtgctgggattaccagtatgagccactgcacctggccttgttgttcctttcttccttttatcttgtagtatcttgatcctttttgcttattatttatcattgaggtgagtttgttctaaataaacttttcgcagaaagtttatgtagatatattaatatcaatgaggcattaggagtgagttttagattagcaggaattctcttatgaaaggtattgattgtatgtgtgagttttcagcctttacttctctccagcccatcaagatcaaagctgcagagttgtttacatttcagaatttctttcctcccctccccaccttgcaaaacagacttacagtgcaaaaatgacttgtcaatgtgattctttcttctggtcccatctttcctaccttttgagacttgtgttgaaaggagtccagtaaaaccaccgatgctagcttgtataccctgatcccattgttataatgaatgactgactgtttttcatatcaaagtataatacttgcaccttgatagaagaaagaaacaaggccaggcacagtggttcatgcctgtaatcccagcactttgggaggctgaagtaggaggaataattagactttgatattaaaaatggggaagatatggcggtataagatatgaggaagtatgtcttcttggacttttctgaaatctgccagccatgagcatccactctttttatcttttgatacctgttttatattaactatacttctattttgtggtttcatggcttcagatatcttccagcttaattgtactctgtctttaattatttgcagcaatttctgaaaggagcaagaagaaaggccagccctttcttcactaccttaaaaactggtcatcttttgaaaccccatgaaaggcacagtgggtgaccatctacatcaggagtgggcaaactatggcccttgggtagtctggtctctgtccgtttttgtaaggttttattggaacccatacacacacaaactgatcatctcttgttatgtgttaagttttcttataattattcttttctatttcatccagctgaattaccatttcaccttgtgtatgccctttccagtcttaaattatagaagctatgtctttgtggttttaaattatggaagctgtgccttcttgtgttttagtatggcaagatatttgttcttacttttcctctagaatctgcagtggattactttcagaagtaggtattgcctctaagtttcctgacttctgtttccttctccctgttctgtagtatatttatagattgcatgttttctcgtccttaaacaaggtacaaatatgttctgatcaaggtttgctagccgagaggataagtggcttgctcttagcctaactctctgtctacttaatggatgtcgaattcccttctcaactcaacagctagtaactagttccaagatcggataatagcttacagaattaattagttcagtgaaagccctggtttgatcacagaggcaggagactgatctatatatttgtagtgctgactagaccccaacttggccagatagcttatacctatgtcagaagttggaggaggagattgacagctgaggtgtctccaagggaattacaattattttcattttctttgtgtctgtaattatgtctcttttcttacttcaaattttgtatatgtgaaatttcttaatttttatttggttatttattttattgactttttcatcaaacaaccaactctaagttcttggattgaaatttatgaattaattataatgttttaaatttaccattagtcacacatacaatacaaaaagatattttcattacaaaattttaacccaagccattaaaactaaactccagcttggtcaccattcctaataccaggcccctctcagaggggagggtaaataaaagtccattttggtaactagtttgacgagaatctctaattgtttccctgtttttcttataatgtctgcctttgaattatcctctttttttcaagagttccatcatataatgtattcctttttgcttacagattgacctcctagaggcatgcatccccctgctccagtctgagctggttctctctaggcctgaggctcagttatcaacttgggacttttatttaccctccctcaggataggtacctggttcttggataccaggtcttactcttgtttgagatactcctttattttggtggcaaacattccataatcacttcctgataatggtgacatttgaggtagattttctgagtctttatatgttagaatatgtttttattctcctttgccacttgattgataatttggctgcacatagaatgtaagcattcacagggcttttgggagcagcttcccttgagaagaaggtggatgcagttaagatcttccctgaaaagactgtgtgaaatgacaaggctattgaggtacccaacgggtagcttggtaaaggtgtatcttgtctcttatgtttatgcatctactttaccaccatgtaattagcctattataacttgttgcattccttcactcagctaatcttgttcatggtagaaattaatattgctagtaccatggtagaattttatattagctggatcctagacctaaatgctccttccttgtgcttacatattctgcaagtgggtgacagtggatgctaggtattgtgttatgtgatttcaatgtattatatgatggggtagatactattagcctcatttgaaaattagaaacctattgttcagaaagtttaagtgactttctcaaagtcacacagctggtaaatggtagaactgggatttgaatccaggcaatctgatggatttaagaggaacctgtgccactatgtgatatagcaataacatctagccaatataaatactttcctgaattaaatcactgtcatattcagagagttctgtgtcactattaagaccctccattattgtgtatattaattacatttccctattttaatcccaatatctattcatttttatcacagtcctttcttatggtcacaaacaggcatagtacaacagcagcaatgcaaaaaccacttttatattacatgttccagggatttaacccaatgacctgtgatataatgatactgactagtattttttcatttatctgggaatgggagagaacctctaacagaacgttttagaatctgtgttatgagtaaccagagtcttattcttcctcatctccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacggaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgagggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacaggtatgaatgcattggttattcctttgctctgctcttgtgacatttgactttaccagatgatgacaccaacaatgagagttagaggatgaaaaatcaaggtgtcttgaaactcttactctggtgagatagagagaagagaggtttacaagagggtagaggaatcagggacaagaaggagcaatggggagcaggaagaaagtcaacctcacctatcaaccttatgagctgcaggggaaatcttagtctcatcagagaactttaagcaaggcagaaggaagaagcaagttcgtgttaaagaggttaaggacttggggaggattggttttcatgatactggggatccagagggcaaagtaggatgattttatttttaggtgagtagagggaggttgagcagtcaagtagtacagagaaatgtggaatataaacataaggagagtcagtcagtcacaaatatttatggaacacctactacatgccagacacttttgtacacattggagtgcagcacagcaggagcttatattctattggaaagagcaagagacaagttagtacaaaactaaataaggcaatctcaattgtgttgttcagaagatagaatagaataatatggtagagagaataatatgatagagtaatacggtagagtgttacattagctgtggtggtcatagaaatcatctttgaggagttgagacctaaatgatgataacaggccagctgatggagctctgagagaagatgtttccagacagagggaagagaaaatgcaaaggccctgagaatggaaaaagtttaccatgtttgaggaacaagaagggacaagcatgacttgtcactttcccaccttgctttctagctcaagtaagcccttattgctgcattgcaaccatagactatttccctagtccactgactttctcattctcctggacctctatcttagattttctgtgttttccttaaatctcgagcaccttttttccattctccaatgcccattttcactcttagctgatgctgtgcaatgaacctccacagactcccaacatcacatttactggcatttgtacccatatactctgcctgcacacttattacaataaatagagtgtctgtgctcctaaggccaacctctccagttttgtacttgattcccatctcttctcccttcataaaaaatgttgctccagcaatttctccttttctcccttacatcatcaatttatctctccactagattaatctcatcaacatcaatcatgctattatttcctcccctatctttacagaaaccgtcttaaaataattgtccctgcttgcagcctttgcatcttttcctgccattctctcctctttaacccactccaaagaagcttttatctctattatttcataagaactacattttcaaggtcattattgatctttacattactgattactagccctcatcttatttgaattctcagtagtatttgagaggtgattactccatcgttgatacaggttctcacttggtttctctaacaccacttttcttcacttttctactaaacttactgccaatctttgtcaactttgcgagtccttcttcatccccctaatctttaaaggttagagtgctccagggattagttctccaacttcttctttattctatttatactcactctgtgacgacattgtttagcctcatgattttaagtactatctatctgcagataattccagttgaatatctggagatattctcagatctctctcctgaagtcaaaatttacatatcaactccctaccttaacatgcacacaattagactcttaattcctgccccttcccaaaacctgctgattgctcagccttctccatggcaatcaaaaaccattcctggccgggcatggtggctcactcctgtaaccccagcacttggggaagctgaggcaggtggattggttgagccccagagttcaagatcagcctgggcaacatggcaaaacctcatctctattaaaaatacaaaaattagccaggcgtggtggtgcacacctgcagtcccagctactcaggaggctgaggcacgagaatcgcttgaactggggagacggaggttgcagtgagctgagatggcctcactgcactccagcctgggcaacagagtcagacttgatctcaaaaaaataaataagtaaaaccattccctatttcagttattcagtcacagatcttgaagttttccaactctttttttcttacattaacatctaatctgtaaaggatcctgtattagtccattttcacactgctaataaagacatacctgagactgggcaatttacaaaagaaagaagtttaatggactcacagttccacatggctggggaggcctcacaatcatggcagaaggcagggaggagcaagttatatctcacatggatggcacaggcaaagagagagagcttgtgcagggaaactcctctttttaaaaccatcagatcttgtgagacttattcactatcatgagaacagcaagggaaggacctactgccatgattcagttacctcctatcaggtccctcccacagaacatgggaattcaagatgagatttgggtagggacacagccaaaccatatcattccaccccatcccctcccaaatctcgtgtcctcacatttcaaaaccaatcatgccttcccaacagtcccccaaagtcataacacatttcagcattaactcaaaagtccacagtccaatgtctcatctaagacaaggcaagtcccttccacctatgagcatgtaaagtcaaaagcaagttagttacttcctagatacaatggggtataggcattgggtaaatacagccattccaaatgggagaaattggccaaaacaaagggcctacaggccccatgcaagtctgaaattctacggggcagtcaaatcttaaatctctaaagtgatctcctttgactccatgtcttgcatctgagtcatgctgatgcaagaggtgggtgcccatggtcttgggcagctccacccctgtggctttgcagggtacagcctcccttgtgtctgccttcatgggctggcattttctgtagcttttccagatgctggtgcaagtttctgatggatctaccattccggggtctggaggacggtggccctcttctcacagctccactaggtggtaccccagtagggactctgtgtgggtgccctgagcccacatttcccttctgcactgccctagcagagtttctacatgaaggcccacccccgcagcaaacttctgcctgggcatccaggcacttccattaatttctaaacaacaaagcattcaagaggcgacttgggtgctattaagggcattcagtttcataagggaagcagagcataaaagtttggaaaatttgcagcctgataatgttagagaaaagcaaatcccattttctgaggagaaattcaagcaggctgcagaaatttgcataagtaatgaggagccgaatgttaatccccaagacaatggggaaaatgtctccagggcatgtcagaggtcttcacaccagcccctcccatcaccggcccagaggcctaagaggaaaaagttgtttcatgggctgggcccaggatccccatgctgtgtgcagcctagggagtcggtgccttgtgtcccagccgctacagccatggctgaaaggggtcaatgtagagctcaggctgtggcttcatagggtacaagtcccaagccttggcagcttccacatgatgttgagcctgcgagtgcacagaagtcaagaactggggtttgggaacttccgcctagatttcagaagatgtatgaaaacacctggatgcctaggcagaagtttgctgcgggggtgggccctcatggagaacctctgctagggcagtgcagaagggaaatgtgggctcagagcacacacacagagtccctgctggggtaccacctagtggagctgtgagaagaggaccaccgtcctccaggccccagaatggtagataccctaaatcatctctttcaaattcgaagttccacaaatctctaggacaggagcaaaatgccaccagtatctttgctaaaacataacaagagttacctttgctccagttcccaacaagttcctcatctctatctgagaccacctcagcctggatttcattgtccatatcattatcagccttttggtcaaagccattcaacaagtctctagagagttccaaactttccacattttcctgtcgtcttctgagccctccaaactgttccaacctctgcctgttacccagttccaaagtcgcttccacatttttgggtatcttttcagcagcaccccactctactggtaccaacttactgtattagtctgttctcacactgctgataaagatatacctgagactgggaaatttacaaaggaaagaggttttatggacttactgttccacatggctggggaggcctcaaaatcatggcagaaggcaaggaggagcaagtcttgtcttacatggatggcagcaggcaaagaaagaaagcttgtgcaggaaaactcttttttttcttttcttctttttagacagagtcttgctctgtcacgcaggctggagtcagtggcgtgatcttggctcactgcaacctccacctcccgggttcaagtgattctcctgcctcagccttccaagtagctggtactacaggcatgtgccaccacatgagatgagattttggtagggacacagccaaaccatatcattccccctgtcccctcccaaatctcatgtcctcacatttcaaaaccaatcatgccttcccaacagtcccccaaagtcataactcatttcagcattaactcaaaagtccacagtatttttagtagagatggggtttcaccatattggccagactggtctctaactcctgaccttatgatccgcccgccttggcctcccaaagcactgggattacaggtgtgagccaccatgcccagccaaaaactcttctttttaaaaccatcagttctcatgagacttattcactatcacaagaacagcataggaaagatctgcccccatgattcaattacctcccaccaggtccctcccacaacacatgggaattcacgatgagatttgggtggggatcctcttggctatcatttcaaaaaatagtcagggttgattatggacttagtattgaataagatgaaaatgtactgaaatggaacgatgaagataattgaccagggaaagcaggttacaagccaagagaggatacagtgtcacttcagatgctataaaagtgatgtttttattttttgaatgttatttggctatattttcaaattatctgcactgcatatgcactgcttctgtaataataaaagggtattaaaataataaaatcaagtctataaatcacacacacacaccccagcctcttctctacacctcagtgactaccaaccacatctaaattatcatcatttctcatctgaattattgcaagaagccattgcaataattcagatgagagttgatacaaagccttcctgtttccaaccttaccctcatatagtcttttcccaacattgcatctaaagtaatttttcaaattgcaattctgatcactgttctctgcttcagatcctccagtggattttcatctcactcagtaaattccaaagccttcaccatggccttcaagaccctacgaaatttgaccctctgcaacctctctgccttcatctgttaccattgtctcctgttaatcctgcctcagccacactgacctccttgttcttctcaaatggactagatgtgtgcctatctctagaccattacagtttctgttctctctacttaaaattatgtccctgatactctaatgcaagttctcttacttccttcaggacgctgctcaaatttcattttatcagtgaggctttccctgaacactgtatgtaaatattgctcccaccattttttttcaatgcacttaacagtgcctgaaatattatatatttatttctttattgtctatcttctctgactataagttaagctcattaagaacacaaactttggaggtattgttcaatgttgtgtccccagaactttgaacagtgcctggcacgtggcagatgttcaaataaatgtatgttgaatgaattagaaaatgataaatgtagggagacaaaagcaggtctcccatttatatccaaactctaggactctaggaaagactgattatatggaatcgtgtcacacagcatccatgggcaagagtggaggcagagataccagttaagatgctattgcagtcatacagataaaagaagacagttatttagaccagtgtggtggtgacagaaatggaaagaaatggaaggatgttgggtataattaaagataagcatataagactggctgttaattgagtatgggaagaatgaggagagaggatgtaaagaacatttctttttgtttgtttgttttgttttgtttttgtttctttttattatactttaagttctagggtacgtgtgcacaacctgcaggtttgttacatatgtatacatgtgccatgttggtgtgctgcgcccattaactcatcatttacattaggtatatctcctaatgctatccctccctcttccccccaccccccaacaggccccggtgtgtgatgttcccctacctgtgtccaagtgttctcattgttcaattcccacctatgagtgagaacatacagtgtttggttttttgtccttgcgatagtttgctgagaatgatggtttccagcttcatccatgtccctacaaaggacatgaactcatccttttttagggctgcatagtattccatggtgtatatgtgccacattttcttaatccagtctatcattgatggacatttgggttggttccaagtctttgctattgtgaatagtgccgcaataaatatacgtgtgcatgtgtctttatagcagcatgatttatagtcctttgggtatatacccagtaatgggatggctgggtcaaatggcatttctagttctagatccctgaggaattgccacactgacttccacaatggttgaactagtttacagtcccaccaacagtgtaaaagtgttcctatttctccacatcctctccagcacgtgttgtttcctgactttttaatgatcgccattctaactggtgtgagatggtatctcactgtggttttgatttgcatttctctgatggccagtgatgatgagcatattttcatgtgtcttttggctgcataaatgtcttcttttgagaagtgtctgttcatatcctttgtataagattattagtggatttctcagaagaaatattgtagaccagaagggagtgaaaatatagatttaaaatcctgaaaggaaataaaaactagcaatgaaaaatactatatccagtaattttatctttcagaaatgaaggggtgataaagattttctcagaaagacaaaagctagatctgctttataagaaatgctagtaggagttcttcaagctgaagaaagaggatgcttattagtaatatgaaaacatatgaaaggataaaactcactagtaaaaataagtacattgtcaaatccaaaacactctagtagtgtaatggcagtgggtaaattaattatatctttagtataaaagataaaagacaaagaaagctattttaaaaactaaagctataataatgtgttaaggaatgcaaattattaaaatatgtaaactgtcacatcaaaaacataaaataggctgggcacagtggctcatggctgtaatcccaacactttgtgggggccaaggtgggaggatcacttgagcccaggcatttgagactaacttgggcaggatagtgagatctcatctctataaaaaatttaaaaattagtaaagcatggtggtgcatgcctgtagtcccagctactcaggaggtggaggtgggaggactgcttgagcctgggggggtcaaggctacagtaagcaatgatcacaccactacactccagcctgggcaacagagcaagaccctgtctcaaaaaaaataataatatgtaggaggaagggaataaaagtgtagagtttgtggatgcaataaaaattaagttgttatcagtttaaaatagcctgctaattttgtgtaagcctcatagtaaccacagagcaaaagcctatagtagatacacaaaacattttaaaaaggtccaaagcataccactacagaaagccatcaaactataaaggaagaatgcaacagaagaagaaaggatcaaaggatctaaaaaaaaaaaaagaaagaaagcaattaacaaaatgacacaagtatgaccaaagtccactgcttctttattactgatatagaatatctttcagatcttaagggactgattaattacttgggagagaaagtttgtgttgagaagatttgcttgtgttgcaatgagaaggggaagttctactcaacagaagctgtacaggcacatatgacaaaagctggtgtaagctttttacagatggtgatgctgctttggaatttgcagacttgtatgagtttaggagtagctacccagatcacaaggaaggggaggaccctaatgaggctgaggagtcgcccttaggaaaggacttagaatatgatgatgaaagcatggaactgattctgccttctgatgccagagtgggtcatcactccttgatgagatactacaaacagtgatttggcttgtcaagagctgtggtagttgctaaatattgtgaggccatgggccgagtgcttcagtaatagagagccctgggatagactggcaacacaggagcagctgttacatgaaagtgagacatgcattatatccaaaggatgaagtcaaaatggatgctgaagacagaaatgaagaacaatgccaccaagcagatgcactttagggtccaagtgagattctgagagtctgccaggattgagtgattgtctgctgcccaagtttcctccttgccctgaggaccagggaaagccagattgtatgatggacacttttgctgctacttcacttgctctaacataataataaaaatgaaaatctaaaaaatattttattgaagaatgaaggtgaaagaaatacattttcagacaagcataaacagagaaacttcaccattagcaaaagtccactaaaatattctaatgttatacttgagacaataaaaaagtgatacagaatggaaggcatgagagacaagatgggataaagagcaaacaaagttaaatatgtggataaatagagataagtatcataaaacatggtcaaatgttttatgagcgttaagatatatagaattgctttattcacagttggtttgctgtcataacacaagtatcatgaaaatcactgctaaatctaagccaaaattgggaaaggaaaaggttcatgtcactatcatcaacgttggacatgtagactcaggaaagttcaacactactggtcatctgatctataaatgtgatgtgatcaacaaaggaaccattgaaaaatttgagaaagaacctgctgagatgggaaagggctcatttgagtatgcttgggtcttggataactataaactgaacatgaatggaatatcaccattgatatctcctaaagaaacctgaggccaaaaatatcctgtgaccatcattgatgccccagcacacaggggctttattaaaaaaaaaaaaaaaaaaaaaaacatgattagagtgatatcaccaaaatggtggatagaagcaatctggcttcactctcctccagaaaaaccaaaaacaactattcagtgtctagcttatcaccaggaatatcccataactcaaaacagaggctgtgaggatctgagtggccacatagaagagaaaaactgcaagcagaagataacaaaaatgggcctgtttaactgcagcatccccttcccaagctgccaggcaccatgcagaaaagttcccccagactgacagtatgtacatcagaaaaagtgacatctagatgaagagccagctttcccaccatcttgggttcctttgcagaaaaatcattcctgcctcaatccgtgggaagcagcctgattgcctctagggtaaaaaaatcctgagggcagctagagacaaaggatggaggcggggctagcaaccccagcatgcaaaacacattggctgctcttcatctaagccaaagaagacaccaaatgagagagaatgttcagcccgtggttcctctggacacaaaatcctaaccagatgtctcacccaaccaggatatccagtttgggacctcccccaaatcgggaataggcagtaatccaagccgttgcaagagctgcagcaaatctgggcttacagcaccatctagtgccaaaaaagaggcagtaatctcagagtaaggaagctctaattcatacataacctttagacaggcatactcctgaaaaaccaaactaagccagacacaaagactggaataaataacttagcattcatacaaagacatagatatatgtgcataaaaaacaagagcaaatagggagctatgacctctccaaatggaaacagcatggagccagtgaccaaccctaatgagatggcaaattgtagctctcaaatcaataattcaaaataaaagttctgaggaaactcaaagaacacaaaaaagcaactgagaaatttatgagataaatttaacagagaaatcaaaataataatttaaaaaaccagaaatgctggagctgagaaatacaactgaacggaaaaaaaaaatgcactggaaagtctaaacagcggaactgatcaagcaaaacgaacaatcaatgagctcaaagacaggctatttgaaaatacacagtcaaaggacaaaaaataattaaaaggaatgaagaacacttgcaagatctagaggactgcctcagtagaacaaatctaagagtcatgggccttcaagagagaaagagcaatgaataaaaagctcaaagaaataacagaaaatatttccaaacctacagagagatgtaagtatccagttataggaaggctgaagatcaccaaacagattcaacccaaataagactaccccaaggcatacaataattaaactctcaaaggtcaaagacaaagaggggatcctaaaaagagcaagaaaaaagaagcaaataacatataaaggagctccagttcatccgggaatatactctggaccagatgaacctacctgacattttacagaacattttatccaactactacagaatatacattcttcttatcagcacatggaacattctccaggatagactatatattaggccagaaaacaagtctcaacatttaaaaaaataaaattatattaagtatcttttctgactacagtagaataaaactagaaatcaatgacaagaggaacgtttgaaactatacaaatacatggaaattaaacaacatgctcctgaacaaccaataagtcaatgaagaaattaagaaggaaatttattgaaacaaatgaaaatggaaacaacataccaaaatgaatgggatacaacaaaagcggtactaagagagaagtttatagctataaatgcctacatcaaaaaagaaagactcaaataaacctggtaatgatgtaactcaaggacatagaaaaacaagagcaaaccaaacccaaaattagtagaaggaaaataataataataatcatagaaataaataatattgagaaaaagaaaacaatatgaaagaccaatgaaatttttaaaatggctttttgaaagataaaatttaaaatctttagctagactaaggaaaaaaaatgagagaagacccaaataattgaaatcaaagatgaaaagagtcattaaaactgataacacaaaaatacaaagtttcactagaaactattatgatcaactatatgccaacaaactggaaaaactagaagaaatggataaatttctggacacatacaacttaccaagattgaactatgaggaaatagaaaacttgagcagaccaataactagtaatgagattgaagcagtagtaaaaagtctggcattaaataaaagtccaggacctgatgacttcactgctgaagaaaaacttacaccaattatactgaaactatttaatattgcaaaaaattgaagagaaaagaatgtttccaaactcattctacaagaccagcattatcccaatacccaaaccagacaaagacacaacaacagcaaaaagaaaactacaggccaacttcgctgatgaatatagatgcaaaaatcctcaacaaagtactagcaaactaaattcaacaacacattaaaatgagtatttgtcatgcccaagggggattcatcctaggaacacaaagatagttcaacatatggaaatcaataaatgtgatacaccacattaacagaaggaaagacaaaaaccatatatttatttcaataaatgtcaagaaagcattgaataaaattcaacatcccttcatgataaaaactctcaacaaatttggtttaaaggagcatacctcaaaacagtaaatgttatatatgacaagcccacagctaacattacaccaaatgggaaaaaattgaaagcctttcctctaagatctggaacaagacaagcatgcccactttcatcaattctattaaatgcagtcctggaagtccaagatggagcaattaagcaaagggccttcaaattagaaaaaaagaaatcaaattccccttgtttgtagacgatataatgttatatttagaaaaacctaaacactccaccaaaaaactgttagaactgatcaacaaattcagtagagttgcaagaagcaaaaccaacatacaaaaatcagtagcatttctatataccaagagctaacaatccgagagagaaatcataaaagcattttcattttcaatagctataataaaaataaatatctaggaacaaatttaaccaaagaggtgaaagatctctatactgacaactgtaaaaccctgatgaaaggaattgaagaagacacacaaaaaatgaaaaggtatctatcccatgttcatagaatggaagaattcatattgttaaaatatcaatactactagatttcatgtattacctatcaaaataccaataacatttttcacagaaatagaaaaagcagtcttaaaatttgtacagaaccacaaaagacccagatatggtttggctgtgtccccacccaaatctcatcttgaattgtagttcccataatccccacatgtcgtgggagggacccagtgggaagtgattgggtcatgggggcagttttcccccatgctgttctcgtgatagtgagtgagttctcatgaaatctgatggttttctaagtgtttggcatttcccctgctggcacttattcccactgccaccttgtgaagaagatgccttgcttcccctacgccttccaccatgattgcaagtttcctgagacctccccagcaatgcggaactgtgagtcaattatacctctttcctttatagattacccagtctccagcagttctttatagcagtatgagaacagactaatacagtaaattggtaccgaggtagggggggcactgctataaggatacctgaaaatgtggaagcaactttggaactgtgtaacaggcagaggatggaacagtttggagggctcagaagaagacaggaaaatgtggcaatgtttggaacttcctagagacctggagggctcagaagaagacaggaaaatctgggaaagtttggaacttcctagagaatcattgaatagctttcaccaaaatgctgatagtgatatggacaatgaagttcagactgaggtggtatcagatggagatgacgaacttgttaggaataggaataaaggtggctcttgctatgctttagcaaagagattggcagcattttgcccctgccctagagatctgtggaactttgaacttgagagagatgatttggggtatctggcagaagaaatttctaagcaacaaagcattccagagtgacagagcataaaagtttgaaaagtttgcagcctgatgatgcagtagaaaagacaaacccattttctggggagaaattcaacccagctacagaaatttatataattaacaaggagccaaatgttaatcaccaagataatggggaaaatgtgtccagggcatgttagagaccttcgcagcagcccctcccatcacaggcctggaggcctaggagggaaaaatgctttcgtggcctgggtccagggctcccctgcagtgttcagcctgggacttggtgccctgtgtcccagccactccagctataagaggccaaagtacagcttgggctatagcttcagagggtgcaagcccccagcctttgttctgtgggtgcacagaagacaaaaattgaggtttgggaatgtccacctagatttcagaggatgtatggaaatgcctggatgtccaggcggaggtgtgctgcagaggcagagccctcgtggagaacctctgctagggcagtgaggaaaagaaatgtggggtgggagcccccacacagtcaccactggggcactgcctagtggagctgtgagaagagggccactgtcctccagaccccagaatggtagatccactgagagcttgcaccgtgggcctggaaaagccacaggcactcaatgccagcccatgaaagcagccaggagcagggctgtaccctgcaaagctatgggggtggagcttcccaaggctgtgggagcctgccttttgtatcagggtgacctaaatgtgagacacggagtcaaaggagaacattttggaactttcaggtttaatgactgccctattggatttcagacttgcatggggcctgtagcccctttgttttggccaatttctcccatttggaatgagtgtatttacccaatgcctgtacccctattgtatctaggaaggaactaacttgcttttgattttacaggctcataaacagaagggattttccttgtctcagatgagactttggacttggacttttgggttaaggctggaatgagctaacactttgggggactgttggaaaggcatgattctgtttttaaatgtgaggacatgagatttgggaggggccatgggtggaaacatatggtttggctctgtgtccccacccaaatctcatcttgaattgtagtatattgtttgtaaaaattcctgcctatccagagattttttaaaaaaaaacaatactttcttcaattttctcttacaatttaattttttacatttaactttttaatacttcctgtagactaaaagttattttggtgcattgtgtgaaccaaagatcaaagtagttttatttttttctgaaaacatctattcattttttcaattaattgattgtttatattaaggatctaggaggatctaaaattatggaattgtgggcaagggcaatttttgccttacatttcatgtaaggcaaaataatccccatgtgtcatgggagggacccagtaggaagtgattggatcatgggggcaggttcccccatgctgttctcatgacagtgagtaagttttcatgagatctgatggttttataagcatctggcatttccccttctgtcacctctccctcctgccaccttgtgaaaaaggtgccttgcttccccttcaccttccaccatgattgtaagtttcctgaggcctctccagccatgtggaactgtaagtcaattaaacctctttcctttataaattatgcagtctcaggcagttctttataccagcaggaaaacagactaatacagaccctaaatatccaaagcagtcctgagcaaagagaacaaagctggaggcatgatgctactttatttcaaactatactacaaagctgtagtaaccaaaacagcatggtactggcataaagacagaaacatatgccagtggaacacaacagagaacccagaaatgaatccacacatttagagccaactcatttttgacaaagtgccaagaatatgcattggtgaaagaatagtctcttcaataaatgatgttgggaaaactggatatccacatgcagaagaattaaactaaacccctatctctcactgtatacaaaaattaaatcaaaatggattagagacttaaatatacaacctgaaagtatgaagctactggaagaaaacattggggaaatgctccaggacattggtctgggaaatattttatggcctgggaaatatcaaaagcacagacaactaaagcaaaagtagacaaacgggattatatcaagctataaagcttccgcacaacaaaggaatcaattaacaaagtgaagggacaacctacaggatgggatgaaatatttgcaaactatacaactgagagggtattaataaccagaatatataaggaactcaaacaagtcaatggcaaaaaagcaaaggatcctattaaaaatgaacaaagatctgaataaacatttctcaaaagaaaacatacaaatggccaacaggtatatgaaaaactgctcaacatcactaattaccagataaatgcaaaccaaaagcacaatggatatttcactccagttaaatgacttttatcaaaaagacaaaaaataatgaatgctgatgaggatgtggcaaaaggggaatgcttgtacactattggtgggagtgtgaattagtacagatactatggaaaagagtatgtatgttcctcaagaaactaaaaatagaacgaccatgtgatccagcaatcccactgctggatatatatccaaagacaggaaatcagtgtatcaaagagatagttgcacaccaacatttattacagcaccattcacaatagctaggatataaaatcaacctaagtatacatcaacagatgaatggataaagactgtgtggtatatatacacaatagactattactcagccattaaaaagaatgaaatcctgtcatttgtggcaacatcgatgagcctggatgtcactgtgttaagtgaaataagccaggcatagaaagacaaatatcacgttttcacttacatgtgagagcttaaaaagtggatctcacggagatagagagtagaatggtgcttaaaggagtttgggaatggtatgggggggtgggatggaatgaagagaggttgattaataggtgtaaaatgaaggggtggcctgcccctcgtcacccacagtgacgagaaacactgtgggtgtttctcgtcaggtgggacgagagactgagaaaagaaataagacacagagacaaagcacaggaaagaaaagtgggcccaggggaccggcgctcagcatacggaggacccgcgccggcactggtctctcagttccctcagtatttattgatcattatctctaccatctcggagagggggatgtggcagaacaatagggtaatagtggagagagggtcagcaggaaaacatgtgaacaaaggtctctgtgtcataaataagtttaaggaaatgtgctgtgccctgatgtgcacgtatacaaacatcttggtgcattaaagagcagtattgccactagcctgtctcacctccagccttaaggcggttttctcttttctcagtaaatagaacatacaatcgggttttacaccgagacactccattgcccagggacgagcaggagacagatgccttcctcttatctcaactgcaaagaggacttcctctttcactaatcctcctcagcacagaccctttacgggtgtcgggctgggggacggtcaggtctttcccttcccacgaggccatatctcaggctatcacatggggagaaaccttggacaatacctggctttccagggcagaggtccctgcggccttccgcagtgtattgtgtccctgggtacttgagattagagaatggtgatgactttttttattattattattatactttaagttctagggtacatgtgcacaacgtgcaggtttgttacacgtgtatacatgcaccatgttggtgtgctgcacccactaactcgtcatttacattaggtatatctcccaatgctatccctccccccaccccatgacaggccccggtgtgtgatgttccccctcctgtgtccaagtgttctcattgttcaattcccacctatgactaagaacatgcggtgtttggttttttgtccttgtgatagtttgctgagaatgatggtttccagattcatccatgtccctgcaaaggacatgaactcatccttttttatggctgcatagtattccatggacaagcatactgccttcaagcacttttttaacaaagcacatcctgcatagccctaaatccattaaaccttgactcaacaccgcacatgtctctgcgagcacagggttggggctagggttacagattaacagcatctcaaggcagaagaatttttcttagtacagaccaaaatggagtctcttatgtctacttctttctacatagacacagtaacagtctgatctctctttcttttccccacagtaaaattacacttaaatagaagggataagttgtagtgttcgatattacagtagggtgactatagttaacaatgatttattgtatgtttcaaaatagctagaagagaagactgggaatgttcccaacacaaataaatgacaaatggttgaagtgattgatattccaattaccatcatttgattattacacattgtattcatgtatcaaaatatcacatgtatccccaaaacatgtacaattatcgtgtatcaatttaaaaatacatcatgataggcacctctcaggttgactgtactgtcctgattattgctagtggtgttaacaaatttgaagctagtatctttaagaacgggcagacccatgagcatgcccttctggtttacacactggaagtgaaacaactaattgttggtgttaaaaaatggatttcactgaactatgccatcgccaacagagctatgtggaaatcaataaggaagtcagccctacattaagaatactggctacaaccgcaacacagtagtatttatgccaatttctggttggaatgctgacaacttgctaacatgccttggttaaagggtggagagtcacctgcagagatggcaataccagtgtagcacaccgcttgaagctctggattatatcataccaccagctcatccaactgacaaggcttgtgcctacctctccaggaagtctacaaaattggtagtattggtaatgtctttgtgggcctagtggtgactggtgccctcaaacccagcatgattggtcagctttgctccagttaacattacaactgaaataaagtcttttgaattgcaccatgaagctttaaatgaagctcttcttggggacaatgtgggcttcagtgtcaagaatgtgtctgtcaaagatgtttatcatggcaatatggcttgtgacagcgaaaatgactcgccaacggaagcagctggcttcctgaaccatccagcccaaatcagtgctggctctccacctctgttggattgtcacacagctcacattgcttgcaggtttgctgagctgaaggtggttgatttccttctggttagaagctggaagatgacccccattgtgatttttattgctatggtttctttctaatttagtcttgaggtctctcccttgagaatggtcataagccaagagagccactttctaggagagtcctgaccagggggaaagttaagtttgagtgtgtcagcttggtgagacacaatgaggaagtaaaaacaaaataaatagtggaatagaatactaacaagtacctagaaataagtctagctaaaaatttgcaaaatgtctatggaaaaaaaaactatggaaatttactgagaaactttaaagagtacctaaataactttcaagatataccacgtacatgaattggaaaacatgatatttgaaaatgtcggttattcccaaactgatttatagattcagtgcaacctgaatgaaaatcccaagacgttccttttgtagagctcaacaagctgattctaaaattaatatgaaaatgtaaaggtttatgaatagccaagtccttcttgaagaggaagaataagatgagagtaattgctgtctaatatattgagacttattttaaagctataataattaaaacaatgtagcagttggtatagggataatcaaacaggtaaatgaaatagaatagaaaatccaaaactagtctaacacatatagaaacttgatttatgacaaaggtgtcacagaagtagagtttcaataaaatgctggaaaatgttggtatctatatagataaaacattacattggattcctaactcacaccatacacaaaaatccattcacattgcattacaagtctaaaagtgaaatataaaatcataaacattttagaaagaaaatgtaaaagaatatatcaataaccacagggtagggaaagaaagagaattgacatcaagatacaaaaagccctagccaataaggtttttttttataaattccacacattaaaattacaaacttatgctcatcaaaagataacataaaaacaatgaaaagattagccacggaatggtaaatgtttgcaatacataacacaaaggacacacaaaggaaacttatataatagattttaacaggcttctctgtgtccttcttctccagcaatcaaggaatatataaaaaagcatatcaaggatatatagggtactcttttgattcaacaagaaaaaagcagattatccaagagaaaacttggcagaaaaaagcttggataggtgctccacaaaagaggacatccaaatgactgctactcataagaaaagatgctcaacctcatagaacatccaaaaatgtaaaaacacagtcaataccagatatttgtaataatttggagcaaatggaactctcatacattgctaatgaaaatggaaaatggtccagctgctttggaaaacagtgtggcaatacctaccaaagccaaacacatgcatacctagtaattccgcccaacagaaatgcacatatatgttcaccaaaagatatgcaccagaaggttatagcaggtccatatgaaagtgccaaagattataacaactcaaatgtccgtgattagggtatattcatataatactatacaacaatgggaatgaacaaactatagctacatatgataatatagatgaatctcacaaccagaatgctaagtgaaagaagaaacaaaagaatatatgtagtatgttttatttacacacttcaaaacaggcaaaactaaactatatttttaaaggatgtatacgtaactggtaaaattataaagaaaagcaaagaaatgattatcataaagatcagaatggtggttaccttcagtgggaagggagaaagtatgattgaaaagggacatccagtgagtcttgtgggttgttggcaatgttactgatctgggtgatgattgcatttatgtaccaaaggcatttgtgttttatgcactttattgtatatgttttagttcacaatttttttagttcacaattttaatagggctttaaaaagtaaaaagaaaagagatccaagggcttgaccatgggactctcttatatttggagtatgtttataaactttacattcattcaacattcgacaaatattttttgagcacctactttgtgccaagcaccgttacaggtgctgggaatacaacagggaacaaaacagacaaaaccccagctttcatggaacttacatgctaataaagcttggcaagagtatttcaaggaagatgaagtggttaactatgcaaaatgcttctcaggcacctaggaaaatgaggatgtgaggcatttctacccacttggtacataaaattattgcttttcctctgctttttttctccagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtgagttaaggacagtggaattacaagaaaattaattttatatatttattttcttgctgactataatgtattcccacttttggaaatttttaaagtatagaaaaataattccataattatctttgtgtacgttctatttttcctatgtatttttctccttatgtattcaaattataccatgcagaattctgattcttgtttttttactaaatatcacatcataaacatttcttacgtcattaaaaacacttcctatgtatgtttttaaaatactgcataatagtctattatatgaatttatggaaccatagtttatgtaaccatttattttgaacaagcttttagacagtttcttttttcactatataaataacgctgtaatcacaacagtttttctaagataaaattccagaagtgcaatgtatttgagcatcttaagagtttttcttattaattatttggtaatgtcccttgcacatttgtctttcatggaggaagtgcttttcttattgattatgttaccttatatattagatagtaaaccactgaacattttaatgagaggtactttttcaagtttttgttttctcttaattttataaatgatggtttttgaaataaaacaggttttaatttttaggtagtaacccatcaatctttactttttgacactttcattgcttttatgtttataaaaattcctgcctatccagagattttttaaaaaacacctatactttcctcagtttttctcttacagtttaattttttacatttaactttttaatacttcctgtagactaaaagttattttggtgcattgtgtgaaccaaagatcaaagtagttttatttttttctgaaaatatctattcgttgtttcaattaattgatggtgtatattaaggatgtagaaggatctaaaattatggaattgtgggcaatttttgccttacattttattttactttccattatattctatgataaatatgtataatttttaatctggaaagtaagccttttttaaaagataatatgcattcattctagaatttgtcatgaagaaccttaacttacatatcaactcctggcgttatggtctcttataacccctgcagtaacattttcccttttactctggaatggcttttatgtgtttaggaattttctcctttgcaactttgagttcataccttaaatttagaatacaaaacctcctcaggattaggtttgagttctaacagcatccatcttctgtaccacttcttccagggtattaaaaactttgataaagaccaaaagacaggtatttcttttagggatgtaaaccctaaggaccttaagatcctagaagattattcttgcttttttttttttgtcgttattgttctacaggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggtaagcaggtgtctattgtgctgaccactttttggtttaaaagaaatggtctttgtgtactaagaattttgatatttatcctacgtgcaataagaagctttaaataggagagttgatcattatatttgtgttttagaaatgtcattctggaatctactgaagaggatggattatatttttggaaggtgggaggcaggttggactggcataaaaattgatgagaaatccactctggttcataggtgagagagcttatactcataggattgatgtcttccctccctaggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatggtaatatattccacatccaaacattatcactgtgaaatgcagattgcactttgacaaatgagacttgatccagggacttgaacattgtatttatttagagtatatctgtgggagtggaatcctcatagatgtcagtttttttggtggagtggagagaaagaaacttatataatagattttaacaggcttctctgtgtccttctccagcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtatgagcttgtttgtgctctttcttctacctactctatttgttgagtacttactttaaatggtctaggcactgggaacacaatcagtgatcaaagcagacaagctccatgctcttaagtaatactttttcaaatgctttttaaaccatttgttcaaagcaaatgaacaagataatttcagatatagaaaaattgctaaaaaggaaatagaacagaataaatggataattaatgtcacagtactttcctagggaaaaggaatttattcctttatcatttaccatctcaaatcccatagggcaccagtagtcatccaaagagtcatttgtttatgtatgtaaccagtatattgattaagcactactcataatgttgatcacaacacaattttattttggttcttcactgtccctttaaaatagatttggccaggtgcgatggctcacacttgtaatcccagcactttgggaggccaaggttggaggattgcttgaggccaggagttcaagaccagcctgggtgacaaagcaagacccccatctctacaaaaaataattagccagacatgtggtatatacctgtagtcccagctacttcacctacttgggtggctgaagtggaaggattgcttgagcccaggaggttgatgctgcagtgagctatgaaagtgccactgcactcaaacttggacaacagagcaagaccctgtctctaaaaaaaaaaaaccatccagtttaatagcgggggtaaactttccttatttcttcgtaaaaattctgataagccctgtaacttttctgctcacccttaagtaataaacaggactaaagtcactttatgtcacaaatacagttcaaatcagaaattacaatgtccatcccaagatattaatcaaaattgtaaacttgatttaacttcaatctcccctcctccaacttgagcctgcatcaggctggaagtctgcattggaaaagggagacatggttgagtcctctgtttctgtaccttgtgatgatcgtgcttccccacaacccctttatagctgctgttttgaactccaacatggataggttaaaggtaaggggataagatagttcttacctatttacagctggcaccattgttgtaaactagcttaacactgtttgtgcctggcaatacttgttgactctttctcctgcagggcactttcagggaactctttagagactcccttacgtgactgtcatgaaatccccttgacatgatttcttccacctttactctgggtggtcacttgtgactcatttctcagccctcagtgttcacctgcagcttcttgttgctggggtaactttacccttgtaggcagctctagtggactggatccagagggaactcaccctgacttatctgtttcacagagtccacatctggccaatgggaaacacaccttttgctcagaaagaccctgggaatgtaggtcaatcataatgcagtagcattctcctgtcccaaccatcaaagaattcagtcaccctgtttctcatctcctggggggaggggagtggtcagaactcaatctccacaacccccaactgtaagggtcacgtagcaagcactttgcatttgaggggtccaaaagtagtggaactaccaaatttggtaggtctactctgatatttcgcataaaccaatgtatctcatgctcattttttagtgaaaagaaataatttctgttcctgttggtttttataaggtgtttttgagacagtggaaatgttaccatccaaagctggaatttggcgggtggaatgccttattggcgagcatctacatgctgggatgagcacactttttctggtgtacagcaatagtgagtagcaatgtgggcagaggttccctacctactcagcctacttctttacagctttcttcctttctggaatggttgcttgtgtcaggaaataaatacaagtttacatcattatcaaatttaaaatgaatattgctggtagaaatcatcagagttctcagagtagggcagatatacttgaagctttgaacactttgtacctgaagctctaaataattgacaaaaaaaaaataccacctcattttcacaacttggtaaagctcgaagatctccagtagcagattttggaatttaatgttgatttagttaccagataacttagaaatactacttggaagagtttggagatttaaccctaaacaagtaagagagccactggtctatttatgtacggaccccagtttcttcagctgtaaaatgtgaatcattctagcacctgttaggattaattaaatgaactaatacagtaaaacgttgagtacagttcttggcacatttaaacactaaaaaatagcatttgttgacgttctcccattttcattgacttacatttgagaagctgaattttgtgcacttctagttactgtgttccacccgtttcatttcagagtgtcagactcccctgggaatggcttctggacacattagagattttcagattacagcttcaggacaatatggtaaatactattatttttgctccaagaacctgggctgattatatctttttttaataatctggtggagaatctcagataatgaatccatctccatgcttctattagttctattccataagtgcctctcaaatacatctcctcctctccacttcccactgtggccatcttaactcaggtcaccatcatttcttacctgggcaatgacactgcctccttaaatatcctccctaccttcagtatttcttccttgagtcaattcttttcagtgcagcaggaagctatactttcctatgagcagtaatggtaaagtttgactagggtctatagagaattctcagaaattgttttagagcactactgcccacaggctaaatgcagcacactgcctgtttttgtatggcatgtgagctatgaacagattttccatttttaaataattgtcaaaaagatgaagactatttcatgacatgtgaaattataaaattcaaatttcagcatccgtaataaagccttattttggaacacagccacgtccattaatttacatatcatctatggctacagcagcagtaacatagttgcaacagagaccatataatatgcaaagcctaaatgatttactatctggccctttacagaaaaagtttgccaacctatgttgttgtgaggtaaaaaaaaatcctcttgaaaaggaggcgtgagagttttacaccaaaatagtaacatttttcactaggtggaagggttacattttaaaatgtcttttatttgtatttttactaatttttacttttcattttctgatttttctacaatgaacatacattgcgtaataaataataggcggggcacgttggctcatgcctcccagcactttgcaaggctgaggcaagcagatcacctgaggtcaggagttcaagaccagcctggccaacatggtgaaactccgtctctactaaaaatacaaaaattagtcgggcatggtggtacgcgattgtagtcccagctacctaggagactgaggcaggagaattgcttgaactcaggaggtggaggttgcagtgagccaagatcatgccattgcactccagcctgggtgacaaagcaagactccatctcaaaaaaagaaagaaaagaagaaataatattattatttggtagtgttggtaacaaattgcagtatcagctagttagaggtgctaacaattaacaaaattataaattttagaaaataaaatggacaacaaggataagcaatatccttagatagtaattgatactggtatgccataaagcctttatgtttttctctattttcaccacagcttagattaacctttctcaagacaataattttattctcaagtgtctaggactaacccagctgaatttaatctctgtttctttacttgggcaaaggacagtgggccccaaagctggccagacttcattattccggatcaatcaatgcctggagcaccaaggagcccttttcttggatcaaggttagaaaatgtaatcaatgatgggaaatgtatcacattcaatcaattgcattacttattcctcttgcaagctcaaaggattctatgaatatgagaaaactaaagaacagaatgccttaatgatttgtacaaaagcagtcatgaacaaagagatatggggatagaattgagtatattgatatgtcctgtttctgtattttagtccttctactgggattagaacatctgaatattttctataatattgaactcgtcatctctcaagacagtatatgttattattagatgcttccaactgcccacgtgtccttaagtactccaatcccctttattttaacataaaacaaatggttcacaaatgcaaaccacatgtgtacttttacattttctgtagccacgttttcaaaaatgtgaaattcactttaataatacattttatttaactcaacatatctgaaaatactatcatttcaacatatgatcaatgaggccccttcaaagacagacagatggaaactcttgggtctcttccatgcctcacaaaagctgagggcagcttggaagtgcctgctcagcctctccacctaaacataaggctagatgccttctagaagcccaaacaggaaatggagaaaacattttggtttccatctttgcaaatagcatgtctattaatgccacagcattgttttgtagacactgccaattttgactcaatctgagctgctgttcactaatccctaagtattttttgttggtttgtgcttctgccaaacaacatgttatgttcttcaccttgtatttctatggttattttcaaccttaagtgtatccctatatagagaacatgtttatctatttggccaccctgtgtctgtctgtgctatttaattttttgtaataacattcttatttgggagggcggaattatatcttcctcactagatacaacctgataagactagtaaatagagtgtcctgtctgtgcctagccaatgaaccctgaatgatatactctgttgtttccacttactagatttggcccattgtttcagcttgccgatcttcagtgtcccaaagtatttcctagtttttccagttactgatttgatcagtaaactttctaatactgcagcaaagtcatgatcaaaatattgaagtagacaagacttccttagtatgtgcacaatacaaatcaagctgttaagtccttactacaaccttgtgaggtagatgttactatcatcttcatttcagataatgaaattgaagcatagagaggttattgtggcccaagtcacatggctaataagtgactgagccaaaattcaaattctgatagttgggctccagaaccctaactggtaatcgttgtactacactgtttccggaatgctccctttaagttgataaccatctattaactgtcactgttcacttgtggtaattaaaccagttacaaatccacctagttatgttatcatctaccactattgaatcgccttatcttcaaggtggttttgccatctgtcctactaaggtccagctagactttttatagatctcgtaactttataaaataaaccatggagatggagttgaaagggggtgctgacaaggaagggagttggagaaggcatctattctcgtgagaaggcctgaagagtgcacaacagcctggccccaagacacaagagcactgggctggcttgaggagcaccaggtgaccaagaccaggcaatgcacagggggaagtcagcaggccccatggagatacgcagctgcagtgtttgtacttttatacagtgaaactcattaccaccttgcttacttcctagtagagagatgtgtcttgtagttacactgaaacacctggctgggcacataggtgaagctgttgagtctgtaattgtcaaactgctcccaggtgccaattataatgtagaagaggcacaagaagatgaagtggataagcctggcagtttgtcaagcattcatcagttgtcaagcatttgtcagttgcagaatgtaggtaggctgccaaggctttattgtagcctggttctattgcagctttattctagcaaggctgctggaaaatacaataatcactggtccaagaaagaactcttatactctatctatatgaagaaacagtaaaagtcaattcagtagaaatcatgatttttgtgcctggtgctttcacttttttatgccacaataccaagaggttaaaatgaagtgtctttgattgggaataccatctatctgggaaaagacagggctgcaacttctgaagaccttgacactctgtcctgttaccctgcttcatttttctcctgcgcttatcactacttgatgctataaacaaataaaaacatatatgatataaggtctatttctcctactcaactgtaagttccatgagggcagggctttctttcttgtttactactctattccctgtatctaaaacagtgcttggcacatagcaagtgctaaaaaatattctttgaatgagtgtatgaatggaacttacagtcagctgaaggagacagttattaagcataagagtgatgaccagtccaattgtgtgtgtcaggcatgtgtgaaaacgtgctaaatttgacttgcttattaggacagtaactgatacttctaatgttcttgcagcccatgacctcttctttaagaagtgtccattctgtactactttcccattattcactcattcattccaaagcatttgctatacagcagtattataccagataccatattaggtgctggggctagagagaatataaaagctaacattgattgagtgtttagtatgcgccaggccctgaactcagcacattacatgtattaactctttaacccctatggcagccctttgagataaaaactaatattatcttcactttacagataagttgagacacagaaagttaggtgactcaaatgggttcactgccttaaggatctcagtctaataaggaaagcagaaaagcaaagcaaccttataatatggtgcaataatttgctataatgaagttatatacaaagtgaagtagaagcatagaagaagcagcactaaatttgtctgggtgagtcagagaaggctaaccaggaaaaatagtttctgaactaacacttgaaggaggtgtagcagttcatcactgacagtgatgttggggtgggtctggtttcaggagaggggaggaaattggctttggtctgaggctgaggtgtgggcaaagcattagcttatgtgggtccattagcttatgtgagtccacaaaaggtgtgtgtgtgtttgtgtgtatgtgtgtgtgtgtgtgtgtgtgtgtgtgtgtacgaaatgggggctcaatgatttggtagtggtttggtttgtcaagaagcaggctgggaactcaataagcatctttccattcatttctactgtgtatcccacagcttcacacacacatgcacatttcaacattggtgactgcttcacttgcacacctaaggtaatgatggacacacctgtagcaatgtagattcttcctaagctaataattagtttcaggaggtagcacatacatttaaaaataggttaaaataaagtgttattttaattggtaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtatgtaattagtcatttaaagggaatgcctgaatactttaaagaattttggcagatttcagatattggacaaacactcttagcttccacaaacttaattccaaaaaataatttttcacttatgagcaatagagttattacggacatatcagcaaaaatgtagtagtgtcaaggctcatagatgatagaaatgaagagatgctgtattgatagaaatatgtgattcaggactgtgtggattgatgattgtgagcttgcttatggatatcctaggtttgaggttatagtaggacaatcaggttgaaatgtccagcaggcagtaggtgaaagacaagtttagggggcaaaaccatggatggagatgaagattcatgacttccacataaaaggatgggtgaaactttgggaattgatgaattctctagaggtgagctcaagacccttaaaggcttaaaacctcagcgttattgtctactcttccctcatttttatgcccacaaatctggtcaatcctttatttgcaatgcctctcacatctctttcttctgtttccatttataccgctgttgccacagcccagggtcccatcacctcacacttgatctattgtattacattcctaactagtcttcccccgtttctaatctgttctccgataaaagctgcacatcattttcaggataatcatcagtcgcctgcctaaaacttttcaatgtcttcccattgtctttagaataaagttcaaagtcttcaaatgaccccaagcaagataacttttgtttgcccctttagatccattttcctgcttctctaccctgcttcttgttctgtgaggtgagcttgtatagaatacatcaacaggttaccttgtcctccagcttttggttggatttcaccaacagggagcactggcaaaagattggcatatttattcttctgactttctccttgcagaggagttcactgtatctccccacttaaggtcactgtttccctcagagtggctttttctacctgtactagctactattgctgtgtaccaagccacttcaaaacttgctgtcataacaataaccattatgttttgctcacagattctgtagatcaagactgggacacagtggggatgggtggtttctggagcctcagttaggattatttaacagctgggtgctggaatcatctggaagttccttctcttgcttttctggtggttggtactgactgtcagctaggacagaatctggggttgttgactgatgtaactttacatggattatccctgaggcctggccttccttacagcatgtttcaaggtagttggacttctttttgagggggggtaggaaggtggggggaggacagagtctcactctgttgcccaggctggagtgcactggtgtgatctcggctcactgcaacctctgcctcccgggctcaagtgattctcctgcctcagcctgctgagtagctgggactacgggctcatgccaccacacccagctaatttttgtatttttagtagagacagggttttgccatgttgaccaggctggtcttgaactcctgacctcaggtgatccgcccacctcagcctcccaaagtgctgggattacaggcacccggcctgtagttggacttcttacacgtcattttagggcctccaagtgtgagtgttacagttaacaaggtgaagactacataaccttttctgaccgagtcttctaagttatgtagcatcacttttgttgacaaaaagtgttgaactctataaaatatttgaagagatttattctgagccaaatatgagtgagtatggcccatgacacagccctcaggaggtcctgagaacatgtgcccaagatggtcagggcacagcttggttttatacattttagagaggcttgagacatcaatcaaatacatttaagaaatacactgatttggtccagaaaggcgggacaactcaacctgggggcttccgggctataggtgaatttaaacattttctggttgacaattggttgagtttgtctgaagacctgggattgatagaaagggaatgttcaggttaagataaacattgtggagaccaaagttcttttgaagtcttatagtggctccccttagagacaatagatgacaaatgttttgtattcagatcttagttaatctctttaggattgggaggggctgggagaaaaagatctagctatgttaatagagattctttacagttgcaaatttccctccacaaagaacagctttgcagggccatttcaaaatatggcaaaaaaacatgttttggggtaaaatattttgattttcttccttgtctcataatgttatgccagagtaaggttggaaagtaaatcatgacatataaggttaaataaaacccatctgatgagaatttatgatttgtagggcatgactccccagaccccttagataggaatttgggcaagataaaaaaaaatcagagtttagtcctcactttcaatacattctattggttataagcaaatcgcatatccacccagattcaaggggaagagacatagaccctaatttttaatgggagaaatgttaaataattggtggtcattttttaaagccactacaataatctatccaattctctctttcaggatgtttctctcttctgatcctttcaggtttagggattgtcaacaaacaaaaagttaaaccctgtaaaatacttgaagagatttattatgagccaaatatgagagaccaatggcctgtgacacagccctcaggagatcctgagaacatgtgctcaaggtggtctggctacaacttggttttacgcattttagggagacataagaccgaaatcaatagatggaagatgtacattcattgagtttggaaaggcaggacaactggaagcgaggcggggcttccaggtcgtaggtagattcaaagattttctgattggcaattggttgaaagagttaagttattgtgtaaagacttagaatcaatagagaggaacatcggggttaagataaggggttgtgaagaccaaggttctgtcatgcagatgaagcctccaggtagcaggcttcagagagaatagattgtaaatgtttcttatcagacttaaagagtctgttctatcagtctgaaggtctgtgttgatgttaatgctggtcagatttttctgaattccaaaagggaggcgggtataataaggcatatttgatccccactttcccatcatggcctgaacgtttttcaggttaactttggaaggccctttgccgaaaggaggggggattagaattttattttgggtttacaggatggtaatactctgttcccaccctcctaactagtatctttattaaaccttccacaaattatcctaatttccatgttttctgttccttgctggatcccttgtttcatacagtaattggtgctagaagaaaccccaggaaacagattttcaaaatgcaattctaaggttatgttgctaatatattcaagaaacacagagataacatatttgccaaggaagaaaatgagcagttagggaatccatgacatgtgttagtattatagtttctcagattatcaccagtgatactatgggatgagttgcagatggcaagtaagacactggggagattaaatgacagtggcatttagtcactgtggcaacaaacgtagcattacctgattgtagagtggtctgtcttcttacagccctagagggcatacacatggaaaaagaaatgaaatgttatgaatatatacaaaataagaacactgatgaacatacatggaaaatcaggatgcatgcatagagcttttgaggaatactccgtatcctgtggttgtaggcagatacgacttaggggctgagcataagttgcagagctgcagtgacaattaaatgcttaactccaccagatctattatgctgtggtaagagtaccggtgggaaggagtgaaactctgaggcctgagatggaggcatttaggcagacatggatgaggctgagaattgcaaacctccaaattcccctgaacctcctttgcctgaggaggcaaccactccccagtctctgaagcagtcatccctcttttgtgtaaaagcctttcagtggctataactgagataggtgcctcacaaaccagtgactattctccttagagaccctgtttggacactacgaaagccaggcgagtcacagaaaatgacagcagatcacaaatttaatcaggtggtgatgccaaaaaacaattgcaattccagatatcatatctctgttgaagcaaatttacacagccccaggcacctgatatggaagtattgacctagagaatgttttttcttcatttccatacattagtaaaatcagaatacatttgaatttaccaagtaggaacaagagtattaagtttactgcccatgcatcagggcaatgttagctctcttgttttctatcataatatagactcaagggacctcaaacatctttacatcccacaagcacaatgcctgtccattacactgatgacattatgctgacaggatctggtaaacacataacaaataagcctgtcttgctcttgactttaatgagaatgtaacctgtgtttcactgtttaatataatgttcactgttagtttcaaatactttttatgatgtttaaaaagttttctcctatccctattttatttgcaatggcaactgaattttatcaaatgcttttccagcatctttgacatggtcacatttctcttttgtgttgtcaaattatacttaacattcaatagtgtgctgacaagaaattaacaacccacaggggagcaaagtgagaagaggttaagaagtaaaggccttgatttatagcattggcagatttccctgacataaatactactcccatcatgcctggccccagggatgggaagagatgcttacttacaattggctctcacagaccagtgcaagagcactactgtgctccatttctgggaaaactttcgtcagtcatagtgtgttagttatttaaaacttagctggatccaatttgccaacatttcatttataatttctatatctatattcatgaatgaaatgggtttagctttttcagtagctctacttaccaggttttggcatgagggttatattaaacttgaaaataaagtgggaaagcttccatttttttccatgaagactattgctctagaatagcttatttaatgtaggaatccagtatttaatgagagtaaatgaaaaagccatatgagccatgtgctttatttagtgagagatactaggctatattttccaatcgttatatgattattgctattctcatttgtgttgccttgagttaatgtctgcaaatgtgcacattagagtcatatatcccttcctgtgccatacatctatatctgtatacacacatatgtcttttctccttttttcccttctgtatcaagagttggcaagtgtttgtctattctattaatttttcaaagaatcagctcagttttaaacccaaacgtggttttgaaagagctgtttctagttcatcaatctctgttcaaaactttaaaaattctattttcctttcttttggtttgtttcctacaatctggaggtgaatgcttagttcacttattcttcaatctttgtattttaacgataaggataaattacttacagttattaactactctcatgaggttcattccttgaacagtcactgagcaactactatgtcctgggttctaattcaggggtgggcaaactatagccccagaatttggcccatagcctgcttttgtacggactgtgagttaagaatagtttttacacgttgaaaggattgcaaagacaaacatacaaagaaacaaagaagactgtgcaacagagaccacctgtggtctgtaaagactaacacatttctatcccgcccttgacagaaagagtctgtgggctgctggtctcctctaacggtggtagagatgcctgcacggttaacattaatccttggcaccagaatcctcagcacctaggaaccagatcttgcctaacacgctaatttcagtcttgaccaccttcctccggcgtagcggttctcaaacgtctttgtctttgtactattcacgtataaaatattctttcataagcaacatttatccttttgggaatacctcacaatggggagaaggggaaccccaacagcctttaagggttcactgcttcgctgccaccatttccgacggtttacactgttttaagtgtgaatttggaattgttttcaagttaaaaagcaaactaatcatgtcctctgaaagtatttgcttttggcatgctagaaatcagtgttgacttttgatactgatgtgatacattacgagggaattctcaaaactgctgaaatctggcctcggcccagttatcactgctcttaagcttctgagggagatacatgaatgagcccacggcaaatggaaaacgaggagttttagtgtttcctagaattatgctcagatacccactacctgaccgtctggttatccttcccctcacctccctgacgcaaggagtttggaccagaggcctaaggaggcttctcctgaagcccaaatcccaaactggtcaccagtcatgctccgtaactcctgaacctgacaagaagccagccggccaggtctgcagcccgggttaagaggagcataccaggaaagagccaaagagcaaaggagcatgagcccttcaaccgcttttacaataatttgggctaggcgttcagggctccgtaggacccttcctggcagccaagtgagagaaagaggaatgatggtggaatgggcctctcctgtgcttcccattacttccacactgtcgaaatagaaatagaagcagaaaagaacaccctacaagtcccacccatttggaggcactcaactcacagtgacaaccctccacacctctcccctgcaaaaagacgcaaaacaaaaacacctactccaaactgtgtccttacatctcagccccgaagatcaggattgtgtgcaacttcggcccaaaggatgcatttccccagggttgaaagtttgagaaagaggctatattctgaagagttcttgttgtcaccatcaaaaggattaaaaagacgcaataaataagaaaacagcgtagttggggggcatgctccatttgagccagaaagccttggaaacttaagtgttctcaaacggaacgccatcctgctttgggggaacacggaggctgccttgcagtcacgtgatcgcacaacaccaaagggccacgcactctgatttcacctacttaactaaaagttgcagcaaaatccctattacaggccaggcgtggtggctcatgcctgtaatcccagcactttgggaggccgaggagggtggatcatttgaggtcaggagttggagaccagcttggccaacatggtgagaccccatctctattaaaaatacaaaaattagcccagcgtggtggtgcacgcctgtaatcccaggcaccctggaggttgaggtaggagaatcgcttgaacccaggaggcggaggttgcagtgagccgagatcacgccactgcgctcctgcctgggcgacagagtgagactccatctcggggggaaaaaaaaaaaaaaaaaaaaaaaaaatccctattacaaataaaagctgttgtgatccagactgcatatacctctgcgaatggaaccagaaccgtgaattccaatgcaaatcgatgcatcggcaccagacccgctgcactggatgtatctgcattgcagtcacccgagtacggagcacatcatagatgatctctgcaggttcgttgcccacataggaggcatagcgcaaatttcaaaggaacgaatacatcctggagcccaaacagctatctggttctgctgctggcctcctgacaagtaggtaagagagtcacattttatagacgacggacaccaaaaccacacatgaggagtacaagagtagctttatcatggatttagggctgtggttacaaggaagctgtaaggaataaaatgactcccatgaagacgtaccgtgcggacgagtggaaggagaaatttggccattacaaagacacaggaatatgttaagaagtgaggggcaggatgaaatcatctagggtaggtatttagagggagggcgccgtgcaaaataaaatcctcactatgaaacaaaggcggaggcaggaggctgcgttaggtggaagcagcggaggaaggagacgaaagggattgtcattttcatgtcgtggctttttagaagacagccatgtcctctactctgattctatcaaaatgtgttctcggggtgctggtaacgttcagccaacgaaataattcctatggcggcagtaggaataacaaaacgcagaagcgggaacgatgtctttttattcctccccagacgcaaacgtggatgcatgaggtttggtaacaggcaaagtcatctggttaacgtgactgatgcaaaaagtccaggcctgggcaaaaagaagtcactgggtgaatgggatggatcagactccctgtcctgagggggagatggtttcttgcagaacgaggtgaaggaggtggttctgctcagcagtcaacagtggccacatctccacctgcagcgacttgatggcttccgtgtccttttcgtgggtagccatgaccaaagactggagcagcagaaagagctcctcgggaagctggccgctgctctcctgcccgtggctgtcaaaagcctcccaggagtacttctccagggtctgggcgtgctccggcagcagcttggcgggcggtggttgcaggaggagcagcagcagcacgcgggacacctcgcagcggaccagcacgtccgagaaggcgcccagggcggcgggagagggcgccgccgagccggagttcggaggaagcagcgcggccggtagggcgggcgtcgccccgggcccgggctggggtgccggcggcgggggcggcggcagtgactgcaccgggtggctgccgtgctcccgcgccaggcgctgcatgcgcgtgaagaccgccagggcgccggtgtagtcgcgcgccagcagctggcaggaggcggcctcgccaagcgcctgcagcgcggccaggggcagctggggcagctggagctgggcggcgcgctggaagtgaccggcggcggcggccggctggcccaggtcgcgcagggcggcggccagctcgaggcagagggcggcggcggcggccggctggcccagctcgaggtgcagacgcaccgcggcgcccagggcgctggcggcggcctgcagcggctccccgtaggcggcggggcagaccaggcgctggcgcgcgtcgcgctcctgccgcaggaagaggcgggcggcctcggtgagggccagcgcctccccgggcccgtggaagagcgcctgctggcagcgcgccaccgccagctggcaccaggccgcgtagggcagacactcctgggcgcgcagctcccggcccagctgtccgaactgctcgccggcctccgccacgttcggcttccgcaggaaccgcttcttcagcttgttcgataccagccggtagcgggccaggaagtccccggcctcgggtcccgggccggcgccgccgccgcccaggcctgcagccgctgccgccatgctcgccgccccaagcacttcccgacgcgccgccgcagctggcgggcgggccggggcggggcgacgtgccctgcgtccccctcggcgggctgccgccgtgcccgcgccggctccccagcccgagcctgccccttgccctgatgaggtgcaaagagcgggatcggaggcggggcctggccgggctgtgagcggcgtatgcaaatcgagggtctcggggatgcggatccaagaccctgggaaggtacgcggggcctggcggggcaccagctgctgctagctcggctgcaatgcaagtggtctaggttgctaaaggcatcccacagcctctccatctgaacatgacccaaacgaaactcgtgaccctaattccatgtctgcgcatttctagactgttgtccccccccccccccgccccgactactcagtcctccgtcttccggtccagggccccttgccaagcaccgggtccacctctccgtccccaccccggttgccttagaagtccgtcctgtcgcaacactgcagtcatggtcttgaggcccacccgccccaacgaacaccatcatgctgaggactttcccgggcaggccctgacttgctcagaaccagcgggggtgtccccttcccacccagggccactcccctgcactgtcacccggagagactgctcctctgtgccatccctggctcccacccaaccccagacccccaccacctctccatccctccagctgtggaggtctcacaaccccccaacccatctcaccgcccccccacccccaccccaaggcaaagtgactgaagcgggcagatggcttccttgaaacattttattgacagaattaatgaaggcccaagactttggggcctgggttgtggggggagggtgtttaaggccgggggttcaggccgggggatttggggccgggtgggtggacgagtggacctgtcaggtcccaggggccgggtgtcagaagctagtcctcgccaggggccacttgagagatggtggtcgtgttgaaaagggtgctcagtagcctgtcgttgtgaaccaccatgtccagcagcaggggagtgatgttccgctctccgctgttctgggcctcgttgcccgccagctccgggaccttggccgtcaggtactcaataaccgcagcgaggtagaccggcgccgtgcgactcaggcgctgagcgtagtggccctcccgtagactgcgctccacctggctcactgaaaacgaaagctccgctcggacggtgcgagagcaggtccgcccccggccgccagcaccggaggaccctcggcgtctcctcctcctcggcatgctgggcgttgagtgtgctatctcggcttggcccagctaggcaagatggctctcaagaggacagttaccgcgtccagtactgtgtatcctagcgaccagggcccagcccctcattggctagggagccgagaccaatgggcacgcacatccggcgacgggcacgcatgtggtgacggcccctcacaagggacacacgtccgtcaggtgacctcatcactttcccattggcctcgagggagcaggcctgggcctagaagtggctggagggccgtgggggtggggtggggcggggcagggggaatcgcgctggtgaccctctctttgccagtgggaactttccctttctactggatgggaacaccgtgggaaagacaaaggggtgggcgaggggaggacgggtaccacgccttcacaatgttgcacatccatcacgaccacctagttccaaaacgttttcaacaccccgaaaagaaaccgaaacccctgtacctataagcagtcacttgccgcacgcctccttccacaccaccactaccagcccccacaccctcccacacacaccccctgcccccgcccatacacacgttcccgatagtccctggcaacccctagtccatctgctttctgtccatagaggttagcctgttctggagatttcctatagatggaattatacgaccaaatgtgaggccgtgtgtgtctggctgctttcacttagcgtaatggtttcatcagggtgcatccatgtagaggcatgaatcactacttccttcctttgaatgactgagtacgattctgttgtatgaataggaggccacattttgtttacccactcgtcagttgatggacaggttatttcccccttctggctattgtgagtggcactgccatgaccatctctctacaggtttttctttgaatatctcttttcagttcttttgggtctatttctagcagtcaaactgctggctcgtgtggtaattctgtttaacttattgaggaaccaccaaactgatttccacagcagctgtaatctttcgcattcccaacagtagtgcatgagagtcccaatttcttcacagcctcatcaaaacctgttttctgtttgcctcattttgttttgtttacagtagccatcctactgggtgtcaagtgctatctcatggtggttttcattcgtatttcccaaatggctaatgatgttgctgtggtttgagtgcatcccccaaattgtgtgtcttggaaacttaatccccaaattcacatgttgattggaggcgcagcctctgagacggtaattaggattagataaggtcatcggggtgagacccccaggatgcgactggtggctttataagaataggaagagaggcctgaaacgacatacacgctcttgccctctcgccgtgtgataccctctgccgtccccagatgccgggtcacttcccagtccccagaacggtaagaaataaatttcttttctttataaattgttcagtgtcgggtattcaattatggcaacagaaaacagactaagacatcttttcatgtgcttcttggccctctgtacctctgctttggaggaatgtctattcaagccctttgcccattttttaattcggttgattgtattttggctgtgggcttctaaaacttattcatatattctggaaaatagactcttatcagatatgtgacttgcaaatgtttctcccattcactttctggatagagccctttgttgcccaaaagatttacatttggatgtagtccaacttgccaaatgaaaagatatctgtggctttgcctttggtgtcatactgaaggagctgttgcctaatccaaggtcgtgcaaagttacatctccgttttcttcttagagttttatagtttcagcccttacatttagatctgtgatccattttgaattaattctttacatgatgtgaggtaggggtccaggggccttcttttgcatgtggctatccagttgtcccagcgcagtttgttgaggggattattcttcccctccacccattgaggggtgccggaactcttactgaaaataaactttacataaatatatgggtttattcctgactctgagttctgtaacattgacctaatgtatcgatcacgatggcagtaccacccttttcggattactgcggttttgtagtacgttttgaaattgggaagtgtgagtccttcaacttttttcttttctgagattgttttggctatctgagccccttacattttcttatgaattttaggatcagcttgtcagtttttacaaagaaggcaggttggattctgacaggcatcacgatgaatctgtatattgccttggagattatgggcatcttaacaatattaagtgtcccaatccgttaacacaaaatgcctttcgatttatttaggtcttctttaatttattttagcaacgtcttgaaattttcagagtatacatcttgtacacctttagttaaatttattcctcgacattttattgtttcgatgctactgtaaaatgaatcatttccttaatcttattttcatgttattcattgctagggtgtagaaatacaaccgactgttgcagattgatcttggatactgcaactttgctgagccgaatatgctttgctgagcatactcagacagggttggcatattagtccgttcctacactgctataaagaactgcctgagaatgggtaattcctaaagaaaagaggtttaattgcctcatggttctgcaggctgtacaaggcttctgcttctgggcaggcctcaggaaacgtgcaatcatggcggaaggcgaaggggaagcaagcaccttcttcacatgttggagcaggaggaagagagagagaacgcacgcaaagggggaagcgctgcacattttcaaacaatcatcagatcttgtgagcgctctatcagaagaatagcaagggggaagtccgcccccatgattcaatcacctcccactaggcccttccttcaacaggtggggattacaattcgacatgagatttgggtggggacacagagccaaaccgtctcagttttttttttttttcttttgttggactctttagtgtcctctatataagaacatgccatctatgcatctatgaatagagatggttttacttgttcctttccgatctggatgccttttatttctttttcttgactaattgccctgactagaactttgagtacgatgttgagttacaagtggcattcctgatcttagggggaaatcaaccagtctttcaccattaagtatgatattatctctgggtttttcatggatgccctctatcaggttgaagaagtttctttctgttcctggtttgttgaatttattttcatgaaagggtactgcgttttgtcaaatgatcctttttgtacatgattaagatgaccatgagccccctcccccgcccccgctccgccatgcattctgttaatatggtgtattatataaattgattttcacatgttgaaccaaccttacatttgtgggataaatcctatttggtcatagtgtataaagagtggtcaataaacatttcgttgaaagaataggagtggatctggcaagcttcttggaggacaatgtgtgtgttaaagaatctgtagcatgatgagaagccaaggcaccggtgggaggaggggagttgcaaccaattcattaaggctggagagtacgatgccagtggagcagtagtggttgatgtggctgggaaagaggtaggcaggagccaagacatggaggttctattatgccatgctcaggttttagaataccctgtaggctacactgaacccactgtggtctttcagcttgggagtgacgtggtctgatttgcctctagaaatatcaccctggaagctgtgtggagaatagaacagagaggattgtgtgtggagaatagaacagagaggactgagattggaattagaaagctgctgtattataccagtcaagaaatgacagatatctcaactaagacaatggcattggtagataagactaggggacagagtccataaaaagtttaggtagtaaaatggcacacagtagacactcactacatattactcatactggtgaacctagctggagacatgataattcatgtgctcattcttcaaaaaatattgaagggtagtgccaggtatactgtgttaagcattgagacaacaccaacgagaaatattctgttgtataaataggccacattttgtttatctactcatcagttgatgaacagttcattaaatgatttccatggcaggggaggtaaatgttgtcctctatcctcttagattctccagctaggacttaaataagatagattaacaaaagaaaagcatacaaaattttatttggcattttttacatgtacatgggagccctcataagaaatacgaagactcaagtgattaattacagctgaatacttacatactagggtgggaaaagtatggtaaattgtgaaaacataacaagacattggggtttgggctaggagagttaattgtggaaaagtcactaagaaggtaagagttgtgtaacaaggttttttggtgcagctttccctcaagcctggactccccatctctggcaataagaatgtgtttcttcttcctggtatacagataatacctttcacatcagagtttcatctcttcctttcatgaaaaaaaaaggaaggtcagtgtgcccttcttgcatctgctactttcaagtgcctttaaacacaaaataatcaatatgccaaagtggcatattttgaggtggcatttgatcccctacattactgattggatagtgtgaatagtgctgccatgaacgctcctgtacaagtgtttgtttgaacagatgttttaaattgcagacgctcctcaacttgggatggtattatatcctgataaacccattgttagttaaaaccattattagtgtaaattcatttaatacagctatattagtccattctcacactgctataaagaactacctgagacttggtaatttatgaagaaaagaggtttaatggactcacagttctgcaggcttaacaggaagcatgactgtgaggcctcaggaaacttacagtcccagcagcaggtaaaggggaagcaagcacgccttaccatggtggagcaggagagacagagagtgaaggacggaaatgtcatacacttttaaaccatcagatctcatgagaactcactcactgtctcaagaacagcaaggggaaatccacccccatgatccaatcacctcccaccaggcctctcctctgacacacggggattacaattcgatgtgagatttgggtggggatacagagccaaaccatatcagcggctaacctaccaatcatcataatttagccaggcctaccttaaacatgctcagaacacttacaattaggctacagttgggcaaaatcatataacgtaaagccaaatttataatgaagtgttgactatctcacgtaatttattcaatattgcactgaaagtgaaaggcagaatggttgtatgtgtactttaagtacttttatgcatatggattctactgaatgcatgttgctttcataccatcataaagtcaaaatattgtaagtccaaccattataagctgggaaccatccatatttgaggtacatacccatgaatatatttatgggtttatttcttgcttcttaattctattccatttatatatatgtctgtccttatgccagtaccacaaagcattgataactgtagctttatacgaagttttgaatttgggaaatgtgagttatccagctttgttattttttaggattattttggctatttgaggtcttgcacaattacacatgaattttaagattggcttttccatttctgccaaaaaaaaaatggccattgggattttgatgcagattgtattaaatctgtagatcactttgggtagtactatcatcttaataatattgtcttccaattcatgaacacaggatatattttcacttctttatgctgtctctaatatctttcagcaatgttttgtagttttcagtgtacaagtcttttacctccttagctgaatttattcctaagtattttattctttttgatgctattttaaatagaattattttttattttgttaatttcatctcagattgttcattgctagtgtgtagaaatacaactgatttttgcacgttgatcttatatcttgcaactttgctgaattcgtttattagctctatagtgttttgtggattcttcggggttttccatacataagctcatgttcatctgagaataagatagctttacttattccttttcaatttggatgccttttatttctttttttcctaattgctctggctaagacttccaatacaattttgaatagaagcagtaaaagcaggcattcttgtctcgtttctaatgttagggaaatatctttcagtcttctaccattgagtgtgatgttagttttgggtattttatgaatgctctttatcatgttgtggattttctcttccatttctagtttgcttagtggtttttttttttttttttttttttggtcatgaaaaggtgctcagctttatcaagtgatttttctgcatcaaccagaatgaacttgcaggggtttttttccctatattttattaatgtggagttgactgggggattgattgtcttatgttgaaccagtcttgcattattgggataatttccacttgagcatgggctataacctttataacatgctgctggatttggtttgctaatattttgttgaagatttttgcacctagatgcataagggaatattatactcacatattcaattacatgcaatttgtaattttcttttcttgtgatatatttgtctggctttgatatcaagatatggtggcctcatagtatgagttgtaaagtttactctccttttctgtctcttggaagagtttaagaaggattaatgttaatccttccttaaacatttagtagaatttaccagtgaggccttctagcacaatgcctggcacataatatatggaatctaggatttgtatagtcagtcattaactatttgttgaattaataaattgtctccccaagcaggtttctaatcaaggcacaaagattgagtaacgaatgaaggcaaagccaatgtatacagggtattagttttctaatgctggggtggcaaattaccacaaacttaatatggcttaaaacaacacaagtttattatcttacagttcgatagggcagaagactgacccaagtcttactgggctaaaatcaaggtgtcatcagggctgcatttctttctggaagctctagaaaaggatcctttttcggtcgcctgtagtcccagctactcgggaggctgaggcaggagaatggcgtgaacccgggaggcggagcttgcagtgagcggagatggcgccactgcactccagcctgggcgacagagtgagactccctctcaaaaaaaaagaaaaagaaaaggatcctttttcctttcttttccagcttctagaggccacacacattcattaactcatggcttccttcctccatcttcgaagccagtaacattgcacctttgtgactattcttaagtagtcacgtctccctttgactctcctcttctgcctctctctctcactttcaaggcctcttgtgattacattgggccgacctggataatccaggatattctccctattttgacatcagctaattggcaaacttaattccatctgcaaccttaaatccctcttgccatgcaacataacacagtcaaatgttctggggattaaaatgtggacatcactgagagatcatattcttcctagcacatacggtttagtcacaagttaatgatcaacatttattagctatataatactcttaagttcaacataaactttttggatgctgataaaacggaatggcattttacattgatatatacttcatttcaaaacttcttctacttctcaatgattattctgtagcaacaaatttcttttaaatcagaaatttggaaacataacgagacctatctcaaatcaaagatgactatccccttttggagtcagactacacattcattattttagtcaaaatgagacataaaattcaggcccccaagagctgccagtacccacttacgcaggaggtagctagacgaaacaggtagctttctacaaatgattttgcaccatcccaccccagagaggtggtttggagtgtttacttattacctgggatttaattatactagctcttgcaaaagccaaatctaaaggccataaatagaaggtcaaattttctcctatatagaaaggagagcagcagagaaaacaaaatccttggtaaatctttaaacaaagttatatggtttgaatatgttattcattctattttaaccccccaatacagatatatttataaaaaagaatattgtgatttctggtataacttgtttaggaacaaagccacaaatttattaatattttctattccctgggaagaaaaaaatgctacatggcagaataattttttaaaatttccagccgggcacggtggcttatgcctgtaatcccagcactttgggaggccgaggtgggcggatcacaaggtcaggagattgagaccatcctggctaacacggtgaaacaccgtctctactaaaaatacaaaacattagctgggtgtggtggtgggcgcctgtagtcccagctactcgggaggctgaggcaagagaatggcgtgaacccgggaggcggagcttgcagtgagccgagatcgcgccacggcactccagcctgggcgacagagcgagactccgtctcaaaaaaaaaaaaaaaaaaaaaattcccatgatactaaactgatgtgtgatcatataatagacttacactgatacctattttagtgtattcaagcagataaaaaatcccaggtgttctatgagtgatatcattttcagtatttcttatgctgtatgccatggtttaaatctaggcctttcgaattggcattactaccatatttctcaaactgtattccctttctcttgaatatgttatgtaattttgtccagaacccagacatgtcaaggtgtcaaatcccacgttttggatactaacgtgtctcattaattcatacagtgggatcattcattaatgcccacattatagactctctctctctctacacacacacacacacacacacacacacacacacacactacattcttagaagatcattctgagaccagggtggaggataggctgtgcattcccagtactctttcacagctgactgtgtcctctgccagtgttttcaaactttactgcttatgaaacagctaagggtcttattaaaatttagattctgattcagtagaactgacatggtgcccaaggaactgcatctcttttaaaaaatctttatttaggtataattgacaaaagttgcatatatttaagaggtacaacttgatgttttgatatattttgtttttcatatatgatgtttgatacattgtgaaatggtcaccacaagcaagctaattaagatatatctatctctttgcctagctacctttttttgtggtgagaacatttatgacctactcttttagcaaatttcaagtatacaatattgtttactatagttactatatcgtacattagatctccagaactaatttatcttgcataattgaaattttgtaccctttgatcaacatctccctgtttcccccacaccacagtccctagcacctaagattctactgtctgcttttatgagtttgaccatcttagattccacatatgaggtcatgaagtatttttctttcagtgtctggcttattacacttagcataatattttccaggttcatccatgttatcacaagtgggaggattttcttctattttaaggccaaataatattttataattgtgggaatattccatcagatatatatatatcagattgtctttatccctccatccatcaatggacacacttaggttgtttccatatcttgactattgtgaatactgttacagtgaacatgggagtgcagatattcaacatactgattttgtatcctttggatatataacagaagtgagattgccagatcacatggtattcatttttagtttttttgaggaacctctatgctgtttttcataatggctgtaccaatttatttttgcagcaacagtgtacaaaggtttccttttctccacattaccaccaacatttgtcatcttttgtctttttgataatagctatttgctatggtttgagtgttttccccaaaaaacatgtgttggaaacttaattcccaatgcgacagtgttgggaggtagggccgaatgggagatgtttaggttatgaggactccaccctcatgaatggattaatgccgattacaaaagcacctaaggctgtgaatttgaattgctctctcttgccctctttttgcccttctgccatgttatgatatagaaagaaggcctttgccagatgctggcctcttgatcttggactgcccagcctccagaactgtgagccaaatacatttctgttcactacaaattactcagtctgtggtattctgtcatagcagcataataaattagagtccataataagttatagtccataacagactaagacactattctaatagatgtgagggaatatctcattgtgttttgatttgcatttccctgtgggttagtgatgctgagcatcatttatctgttggccttttatatttcttcttttgaaaaattctatttgggttctttgcccatttttaattgggttgtttcttactaatgagttgtttgagtttcttacccattatcagatatacagtttgcaaatattttcatccattccataggttgtcttttcactctgttgattatttcttttgctgtgcagaaagtttttagtttaatgcaatcccagtttctatttttgtttttgttgcctgtgcttttggtgtcatataaaaaaattattgcccaaatcaatatcaggtagcttttttcctgttttcttctaggagttttatagtttcaggtcttatatacaagtgtttaatcaattttgagttgaattttatgtatagtgtgagaaaagggcccaatttctttcttctgcatgtggatattcagttttcccaatatcatttattgaagagactctcttttccccgttgtgtgttcttggcacccttgtcaaaaatctgttgactgtaaatgtgtgaacttatttctgggcttttctattctgttcccttggttgatgtgtctatttttatgccagtaccatactattttgattactggagacttgtagtatattttgaaatcaggaagtatgatgcctctagctttgttcttcttgcttaagattgctttgccaggctgcatgtggtggcccacgcctgtaatcccagcactttgggaggctgaggtgggtggatcacttgaggtcagaagtttaagagcagcctggccaacatggtgaaaccccgtctctactgaaaaaatacaaaaattagccaggtgtggtagcaggcccctgtgatcccagctaatctggaggctgaggtggagaatcacttaaacctgggaggcagaggttgtagtgagccaagatcgcaccactgcactccagcctgggcaacagagcaagactctgtctcaaaaaaaaaaaaaaaagattgctttgcctccttggggtcttttgtgatttcatattaattaaaattttttttttatttctgtgaagaacaccattgagattttgatagggatcacatcaaatctatagattactttgggtagtgtggacattttaacaatactaattcttccaatctaggaatatggaatatcttttatttatctgtgtcttctttaatttccttcataaatgttttctatattttcattgtacaagtctttcatttctttggttaagtctattcctaagtattttattcttttgttgctattgtaaataagattattttctaatttcctttgggatattttatagtgtatagaaacaccactgatttctgtatgttgattttgtatcctgcaactttacagaattcatgtattagttctaacaatttttttttgagtctttagagttttctacatgtatgatcatgtcatctgcaaaaagagataattttactattctcttctatttggatgctttttattttatttattttttaaattatattttaagttctgggttacatgagcagaacatgcagttttgttacataggtatacacgtgccctggtggtttgctgcacccatcaacccgtcacctacattaggtatttctcctaatgttatccctcccctagccccccaccccccaacaggccccagcgtgtgatgttccactccctgtttccatgtgttctcattgttcagctcccacttatgagtgagaacatgcagtgtttggttttctgatcttgtgatagtttttgagaatgatggtttccagcttcatccatgtccctgcaaaggacaggaactcatccttttttatggctgtatagtattccatggtgtatatgtgctacattttcttaatccagtctatcattgatggacatttgggttggttccaagtcttcgctattgtgaatagtgccacagtaaacatacatgtgcatgtgtctttattgtagaatgatttataatcctttgggtatatgcccagtagtgggatttgctgggtcaaatggtatttctagttctagatccttgaggaatcgccatactgtcttccacaatggttgaattaatttacactcccatcaacagtgtaaaagcgttcctatttttccacaacctctccagcatctgttgtttcctgactttttaatgatcaccgttctaactggcgtgagttggtatctcattgtggttttgatttgcatttctttaatgaccagtgatgatcagcattttttcaaatgtctgttggctgcataaatgtcttcttttgagaagtgtctgttcatatcctttgcccattttttgatggggttgtttgtttttttcttgtaaatttgtttaagttctttgtagattctggatattagccctttctcagatggatagattgcaaaaattttctcccatcctgtaggttgcctgctcaccctgatgatagtttcttttgctgtgcagaagctctttagtttaattagatctcctttgtcaattttggcttttgttgccattgcttttggtgttttagacatgaagtctttgcccatgcctatctcctgaatggtattgcccaggttttcttctaggatttttatggtcctaggtcttacgtttaagtatttgatccatcttgagttgatttttgtaaaaggtgtaaggaagggatccagtttcagttttctgcatatggctagccagttttcccaacaccatttattaaatagggaatcttttccccattgcttgtttgtgtcaggtttgtcaaagatcatatggttgtaactgtgtggtgttatttctgaggcctccattctgttccattggtctgcatatctgtttggccccagtaccatgctgttttggttactgtagccttgtagtatagtttcaagtcaggtagcatgatgcctccagctttgtccttcttgtccaggattgtcttggctatgagggctctttgttggttccatatgaagtttaaagtagtgttttccaattctgtgaagaaagtcagtggtagcttgatggagatggcattgaatctataaattactttgggcagtatggccattttcatgataatgattcttcctatccatgagcatggaatgtttttccatttgtttgtgtcctctcttatttccttgatcagtggtttatagttttccttgaagaggtccttcacatctcttataagttgtattcgtaggtattttattttcttagtagcaattgtgaatgggagttcactcatgatttggctctctgtttgtctgttattggtgtataggaatgcttgtgatttttgtacattgattttgtaccctgagactttactgaagttgcttatcagcttaaggaggttttgggctgagatgatggggttttctaaatatacaatcatgtcatctgcaaagagagacaatttgacttcctcttttcctatttgaataccctttattgctttctcttgcctgattgccctggccagaacttccaatactatgttgaataggagtggtgagagagggcatccctgtcttgtgccagttttcaaagggaatgcttccagtttttgcccattcagtatgatattggctgtgcgtttgtcataaatagctcttattattttgagatatgttccaccgatacatagtttattgagagtttttagcatgaaggggtgttgaattttatcgaaggccttttctgcatctattgagataatcatgtggtttttgtcattggttctgtttatgtgatggattatgtttattgatttgcatatgttgaaccagccttgcatcccagggatgaagccaacttgattgtggtagataagctttttgatgtgctgctggatttggtttgccagtgttttattgaggatttttgtatcgatgttcatcagggatattggcctgaaattttctttttttgttgtgtctctgtcaggttttggtatcaggatgatgctggcttcataaaatgagttagggaggattccctctttttctattgtttggaatagtttcagaaggaatggtaccagctcctctttgtgcctctggtagaatttgtctgtgaatccgtctggtcctgtactttttttggttggtaggctattaattactgcctcaatttcagaacttgttataggtctattcagggattcaacttcttcctggcttagacttgggagggtgtatgtgtccaggaatttatctatttcttctagattttctagtttatctgcatagacgtgtttatagtattctctgatggtagtttgtatttctgtgggatcagtggtgatatccccaatatcattttttattgcatctatttgattcttctctcttttcctctttattagtgtggctagaagtctatctattttgttgattttttcaaaaaaaccagctcctggattcaatgattttttgaaggtttttttgtgtctctatctccttcagttctgctctgatcttagttatttcctgtcttctgctagcttttgaatttgtttgctgttgcttctctaattctttaattttgatgttagggtgtcaattttcaatttttcttgctttctcttgtgggcatttagtgctgtaaatttccctctaaacactgctttaagtgtgtcccagaaattctggtacgctgtgtcttcattctcattggtttcaaagaacatctttatatctgccttcatttcattatttacccagtagtcattcaggagcaggttgttcagtttccatgtatttttgtggttttgagtgtgtttcttaatcctgagttctaatttgattgcactgtggtctgagagactgtttgttatgatttccattcttttgtatttgctgaggagtgttttacttcgaattatgtaatcagttttagaataagtgtaatgtggtgctgagaagaatgtataatctgttgatttggggtggagagttctgtagatctctattaggtctgcttggtccagagctgagttcaagtcctgaatatccttgttaattttctgtctcattaatctaatattgacagtggggtgttaaagtatcccactattattgtgtgggagtctacgtctctttgtatgtctctaagaacttgctttatgaatctgggtgctcctgtattgggtgcatatgtatttaggatagttagctcttcttgctgcatttttccctttaccattatgtgatgctcttctttgtctcttttggtctttgttggtttaaagtctgttttatcagagattaggattgcaactcttgcttttttttttgctttccatttgcttggtaaatattcctccatccctttattttgagcctatgtgtgtctttgcaagtgagatgagtctcctgaatacagcatactgatgggtcttgactctttatccaatttgccagtctgtgtcttttaattggggtatttagcccatttacatttaaggttaatattgttatgtgtgaatttgatcctgtcattatgatgctagctggttgttttgcccattagttaatgcagtttcttcatagtgtcaatgttctttacaatttggtatgtttttgcagtggctagtaccagttgttcctttccatgtttagtgcttctttcaggagctcttgtaaggcaggtctgatggtgacaaaatccctcagcattcggttgtctgtaaagaatttcatttctccttcacttatgaagctttaagaggtttaattgactcacagttctgcatggctgtcccataagtcccatgttctttcctcaggaaacctacagtcatagcagaaagggaaataggcacatcttacatggcagcaggcaagagagagtgtgtgaaggaggaactgtcaaacacttataaaaccatcagctctcataagaactcactatcaggagaacagcgtgggggaaaccatccccatgatccaatcacctcccactaggtccctcccttgacatgtgggcattatggggattacgattcaaggtgagatttgagtgggaacatagagccaaaccatatcagtatctaaaaggaaaaaccttcagtttttccacatttggttatgatatcagctgtgagcttttcctatatggtctttattgtgttaagttccttctgtatctatcttgctgaaagtttttattatgaatggatatctagttttgtcaaattctttttctgtattgatcgaaataatcatgtgtttttcatctttcattctgataatgtggtatatcacattgattgatttgcccatgttgaaccatccttgcatcctagggataaataccacttgttcatgatgaatgatccttttaatgtgctgttgaatttggttggctggtgttttgttgaggatttttgtatccgtgttcatcagggatattggcctgtagttttctttcttttcttttcattttctttttctttctttttttttttttttttttttgagacagagtcttgctctgtcacccaggctggagtgcagtggtggtatgatcttggctcactacaacctccacctcctggattcaagcgattctcctgcctcagcctcctgagtagctgggactactggaacatgccatcacacccagctaatttttgtatttttttagtagagatgagttttcaccttgttggccaggctggtctcgaattcctgacctcaagtgatttgcctgcttcagcctcccaaagtgttgggattacaggcttgagccaccacacctggcctggcctgtagttttcttttctagtgttgtttttgcctggatatggtatcagggtgatgttggctaataaattgtattttgaagtgttctctcttgtattttttggaagagtttaagaaatactggtattaatacttcgttgaatgtttgatggaattcatccatgaagccattggtcctgggcttttctttgttggaaggtttttgattactagatttaatatccctatttgttgttagtctgttaaggctttctatttctttgttattcagttttggtatgttatatgtttctaggaatttatccatttcctctaggttaaccaatttgttgacacttataatagtcccttatggttctgtctgtttctgtgacatcagttgtagtgtctcctctttcatttatattttatttatatgagtcttctctctttttttcgtagtctagataaggacttgtcaattttgtttattttttcaaaaaaatcaactcttagttttgtcagttatttccaattgtttttttattctcttttttatttatttctgctctagcatttattatctcctttgttctgctacctttgggcttagttttttttttcttctttttgtagttcctggaggtgataagttgggttgtttatttcatatgtttcttctttttaaatataggcatttattgctataaatttccctattagtatgcttttactgcatcctttaagttttggtatattatcaagattttggtttcttctgtgacccaatggtcgttcaagaatgtgttgtttagtttccacatatttgtgaattttcgtgttttcttattgttattgatttgtagtttcaatccattgtggtcagaaaatatacttggtatgatattaatcttcttaaatttattatgacttgttttgtgacctgaaaggtgatctgtcctgaagaatgttttgtgtgtgcttgataattctactgttgggtggaaagttctgtatatacattttaggtccattgggtctattttattcttcagttctgttttgtccttattgattttctgttgggatgatctattcattatagagagtggagtattgaagtcaactatattatattgttatctatttctccttccatgtctgtcaatgtttgctttatatatttaggtactttcgtgttgggtacatatatatttataattattacatcttcctgttcaagtgacccttttattatataatgaccttctatgtctcatgtcacagttttttacttaaagactattttttctcatacaagtatagccacccctgctctcttttggttacagtttgcatggcataactttctccaccccttcactttcagcctatgtatgtccttaaatcaaaagtgagtctgttatcaacaacatgtagttgggtcctgtttatttttgtttcttacttcccatctctgaattgttggctttttaaaaagcccattcagttactctgtgtcttttgactggggagtttagtcaatttacacttaaagtaattattgataggttaggactttctgttgccattctgttaatagttttctgttttgtagttttcttgttcctttcctctttttctttctttgtggtttgatgatttttgcttggatgtgttttgattcttttctctttatcttctgtatatctactgtgtgggggggcggtcgggggggttaccacagggatcaaattgaacactttatagttatggcagtctgttttaagctgacaacaccttcaatcacatacagaaactctatactttactcattccccccgccacaactttatgtaatcgacgtcatattttacttccttctatattgtgtttccattgacaaatttctgtcactatagttactattactatttttgtcttttaatttataaattaatattaatagtgatttataacaatcattatagtgttacaatagtctatgtttctctttatatttacctttagcagtgaaaggattcatatgcttttgtgttactgttttttttttatttcaacttgaagaactattagcacttcttataaggcaggtctcatggtgacaaaccccctcagtttttgtttgagaaaggctttatctttgtgttcattcttaaaggacagtttttccagataaagtattgttgattggatttttttctctcagtactttgaatatatcatcccactctttcctgacctgcaaggtttctgctgagatatccactcatagtcttatggagctcccctataggtgacaattcactttcttcttactaccccaaaattctcttttgtctttgttgaaaatttaattataatgcatctcactgtagacttctgtgggtttaatgtatttggttatctttgggcttaatgaatccagatggcacttcccctccatagatttggggagttctcacctattatttctttaaataagtttcctttctctctctcttctccttttaagatttctataatgcatctatcattttgcttgatgatgtcccataagtcctctgttcttccttcactctttctcattgttctttttattccgctaactagataatttcaaatgacttgtcttcaagtttacaaattctttcttctgaatgattgagtctgctattaaagatcgctattaaattttttagttcagtcattcttcagctatattcagcaatattctttagctacaggatttttatttggttcttttttatggtttttatttctttattaaacttctaatgttgttcatgtattgttttcctcattttgttagtcgtcttcctgtatcctcttgtagctaattgagcttctttaaatgattattttgaattctttgtcaaaaatttcatgaatctccatttcttcagggttggttactggagctttattagttccctttggtgatgtcatatttgcctgattcttcatgatccacatagcctagcattggtatctgtgcattggagtgagctgacacctcttctggtctgaagttgggtactcagacaatgggcccattaccagggctttggataggtgtagctctcactgggtccttgagtgggcaggactgcctgcagaccatgatgcagtgggcctggagctgggtcaaagggctgcttcagggtccccacttgggcccacagtcagtgggcctgttatgggggcacaggtaagtgtggattcaggcaggactgtctccagaacatggtacagcaagactggagttggctcacagggttacttctgagtccacagtcaggtctagttggtgggcctgcttccagaggtggactggcatgactcccacctgtttcctaagtaggcaaaacttccccaagaccatggtagtgtggtactgaagctgctttaggtacagggctgcttcagagtccacagttgggagccctgttactggggttgccaatgggagttgctcctcccagattcctgggcagatagggatagtggtaggaccacatacaaacaactctggagctaagtccccagggtggtgggctgcttctgggtccacaaccagaactacagttgacaggcctgccgctagaatgtgggcctgccttattaaagtattcatctttgttcttgagctctaccagggtttctcaacctcctacctgaatcccaaggctcccacaaagacacttttgtccatagatcattgtcaaattattgttcctgtgggggaacaagagctagggacctcctatcccatcaactcactgataccgttctcctgatgctgcattttgaattgccctcaggtgatgctgctactcctggtctgtggaccatgctggagtagcagagcccaaatggcttcctcaacttttatgagccttttacaggaactcaaagtagaaaataacttcacttgccccagacctaataatttcctttgttcccacttcttcttggtgctttcctcctttgtgtctaccatcgtaacatccatctaaccatagttgtcttatgtagatgttggatgctgttgagaaacgcacaaagcaaattagaaggaagatatgattgacagaaattgctttttactctgtattcactttccatgtatttgtgctaatctctccatacaggtcttctttggcaatgtggattcatctgggataaaacacaatatttttaaccctccaattattgctcgatacatccgtttgcacccaactcattatagcattcgcagcactcttcgcatggagttgatgggctgtgatttaaatagtaagtgccaagtcatcccatatccttcttccctcaaccatgggtagggtgactaactgttctagttatcctgagactgggggaggggttcccggtatcaggacacaaaattgtcagtgctaaaaccagcatagtcctgggcaaacccagaaataccattcaacccagcagtcccatcactgggtatataatcaaaggaatataaatcattctgtcataaagacacatgcacgcatatgttcatttcagcactattcacaatagcaaaggcatggagtcaacctaaatgcccatcaacaacagattggataaagaaaatgtggtacatacataccatggaatactatgcagccataaaaaagaatgagatcatgtccttttcagcaacatagatgcagctagaggccattatcataaatgaactaatgcaggaacagaaaaccaaatatcatgtgttctcataagtgggagctaaacattaaatgcacatggacacaatgatggacactcaggaggggagaggttgggaggggggtgtgggttagaaggttatgtattgtgtactgcactcactacctgagtgaggggatcattcatacaccaagcctcagtgacatgcaatttacccatgcaacaaacctacccatgtacccctagaatctaaaataaaagtagaagaagaaaagaaacaaagaaaattaaagagtcacacaaagtgggaagagctggctggaaaacagatagcaataacagaattggccgggcgtggtggctcacacctgtaatcccagcactttgtgaggccaaggcgggtggatcacgaggtcaggagatcaagaccatcctggctaacatagtgaaaccccaactctactaaaaatacaaaaaattagccgggtgtggtggtgtgcgcctgtagtcccagctactcgggaggctgaggcaagagaatcgcttgaactcgggaggcagaggttgcagtgagctgagatcatgccactacactccagcctgggtgacaaagcgagactccatctcaaaaaaacaaaaacaaaacaaaacaaaacaaaaaaccaataacagaatctgtgcaaaagttaaaacctgagaaatgatattatgatgacagtagccctagaatatcagtggaagctgctcagtataactgaggctgaagcatgtccttgtgataaccttcttttttcttttctttgaggttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtaagaggcaacagatttactgtttaactgactcagagcagtggttggggaaaaaatcggggaaggccttgactgtttcttctgaggtatttctgtcaactgttagttctaaaaagtgtgtcaaggaagtttggttatgggcagacaaccacacaggcatttgggggaaatgatctctaattgaacctcctggaagaagaatctctatatctagtactgagctaatatctgtcaaagaattgtagaagctaaagtccattttacagataaatatcaacaattagctttctttccaggtttctcattacatcaatgaaaagtaaacatttactgcacatcttagtatccctaggatgagcctagggatacaaaggtgaattgtgaaaaattttggccctgaagttgcttagagttgaataagagagactgactagccaatagaaagtggaggctgggtgcggtggctcatgcctgtaatcccagcactttgggaggctgaggcgggccgatcacaaggtcaggagttctagatcactcttttgctgaggcaggataatcgcatgaacctgggaggcggaggttgcagtgagctgagatcatgctattgcactccagcccaggcaacagtgcctgactctgtctgaaagaggcagagagagagagagagagaaagaaaggaaagaaggaaggaagaaaaagaaagaaaggaaggaaggaaggaggccgggcagagtggctcacgcctgtaatcctagcactttgggaggcctaggtggcagatcacctgaagtcaggagttcaagaccagcctggccaacctggtgaaacctcatctctactaaaaatataaaattatctggacatggtggtgggcacctgtaaccacagctactcgggaagctgaggcaggagaatcggttgaactcgggaggcagaggttcagtgagctgagatcatgccattgcactacagcctgggtgacagagcaagactccgtctcaaaaaagaaagtagagtgagaagtgctgtggtatggttaagagggatttgggaatttctgggagtaaatggtgaccaagaggctactagtccaactctattgccctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtaagctggtctccttggaaagaaagaaagaaagaaaaaaaataccacctctcctagagcttaacataacataaaaaggttgatatatgaccaaattttcagagcaaaatttattaagtacctatggtagcaagacattgtaaaaggcattctgagagaacacagtgactttaagaaaaaggtaaaatactgagaaaagggcagagtagatccaagagttaattctcctcatcagcaccttgattcccaagcctttttgacctttaagtttagtggtccaggaagtcttcattcttaatctgggtttgctggataattcaacaaattgtcctgattaaaagacatgacataaagtcttatcaccccatgagtaatgggggaaggaatagttcctctctttggtattttttatattcttttttcaccaagaattaaccatgatgtggtccttaccaatctctctaatacagtctcttgccacttggctctttaagctccatccatactaagaaattctcaggtcactaaatacagccattatatctcataccaggcttttaaatagatactatttcttctacctggaacatttttctagctaccctctactgccactttcacctgactcattcgttaagtctcaggtaaacatcatgtccaagaagaattcccttatccatcaaggctggatgaaagacttcaccaaactggcagtttggtgaactgaagtctagacattggatattctagaagaaaaattcccatttaaaaaaggttatatctctgattagtgccacaacatgatgaactttcaaaatatgctaagtgaaggccgggcgcggtggctgatgcctgtaatcccagcactttgggaggctgaggcaggcagatcacgaggtcggtaaattgagaccatcctggctaacacagtgaaaccccatctctactaaaaatacaaaaaattagccaagcgtggtggcgggtgcctgtagtcccagctactcgggaggctgagacaggagaatggcatgaacccgggaggcagagcttgcagtgagccgagatcgcaccactgcattccaacctgggcaacagagtgagactccatctcaaaaaaaaaaaaaaaagaaaatacgctaagtgaataggccagacataaaaggatagatattatatgattctacttatatgagtgtgttagtcagggatatccaaagaaatagaaccaataggagattctgtctgtctgtctctctctctctgtctctctggatgagctaaactgttttagttcaagactgaaagcaggaaaaagctgatgttccagtccaaaggcagacaggcagcaagaatactttcttacttggggaagactcagtctttttgttctattcaggccttcaactaattggatgatgcctcccacattagggagagcaatctgctttactcagtctactgacttcgatgttaatcccattcaaaaacaccttcacagaaataaccagaataatgtttgagtaaatatctgggcaccttatgaccaagtaaagtagatacataaaattaaccatgacaagtccaccccttgtcaatgtagcacccatcatacacatctcctttatctctaagtagagacaaaaatgaggtcataattccacctaacatgatataacaaaacttggctggtattgataactaccttcttctactacccattctgtattgactttgccttcagcaagcatctcagctgattgtggttctttacctgatgaggtgacccaaacctttattcctgaagagcctgggccactagtagtcctgcatggattgggttgctgtagtttcccattgaccagaatcatagggcctggtaatactaagagacactctaagggatctattgtattccagacacactcttccatacctccattgtgaagcagtagttcagtttccttccaggaaggacaaaacgctgccccttccatgatgaacatattccaatgtaatcaacctgctgccagatagctggctgatcatcctgggaaatactgccatactgaggactctgtgtttgtctctactgctggcagattgggcacttagcagtggccatagccaggtcagccttgttgaatagaagtccatgttgctgagcccatgcatagcctctatccctgccaccatggctactttgttcatgagcccatcaggcagtgacataggtggctgagtaaaaaggatgactggtatccacagaacaggtcatcatatctactttttttttgagatggagtcttgctctgttgcccaggctggagtgcagtggcacaatctcagctcactgcaacctctgcctcccaggttcaagcatttctcgtgcctcagcctcccgagtagctgggactacaggcacgcatcaccatgcctggctaatttttgtatttttagtagagacagggtttcaccatgttggccaggctggtcttgaactcctgacttcaggtgatcctcccgccttggcttcccaaagtgctgggattacaggcgtgagccactgcacccggcccatcatatttacttgattattgaaatccttatctgctgaggtcacccttcgttgagcactcacatgggacataaatatattcacatcctttgcccattcagagagatctgtccacatacctcttccccaaatttctttgtcacctgttttctaatcatgttccttccaagtccctatctggacaaagcactgactacagcccattacttgacatataattgcacacctggccatttctccttctaagcaaagtccacaaccaggtacactgcctaaaattctgcccactgtccttcatgggtatctcagatcgggactgtccacttttgtgtagtacctgcatatcgtgcagaaccgtctgtaaaccaggcccaagactcctcttcctctgtaaactgatcatagggaactcccaatggggccataagtgcaggctgggagagagaaggcagggtagcagaaacaggcaccatggacatttgggctacttcttcatgtaatttacatgtgttttcagtacctgctcagacatgatcatgtatataccacttccatttgatgatggagtgccattgttcatacccaactttatggcttggtgggtcagataacacctagttcatgatgggcagttcaggtcacatggcaacttggtggtctgtggctaagcattcagtatctactaaggcccagtagtaggccaagagctatctcacaaaaggagaacagttattcacagaggattacaggaggatttctcactacagtagcccctgctccataggtcagggaaccaatgtgaagatcctgctagctgctcaatatatctgttccaattacgcattccaggactggggaaataaccacaagatagtctcacagatcctctgcatccactttgagatggacttgagctaaaattccattgatcatttgaccctccataagcccatactctgactggtggaccacagtgacattttgggtctcctgaaattagtgccagttcagagccattgtccagtagtccctgaaaggtctgattaattatttttcttcagtgcacatttattctgatagaaaggccatatgtccctttggggaaggctgagagaaagagtggcagtattcttggcagtgtaccagagtccttcctcaaggagactgagcctccccttcattcaaggagtgctgggtctgtaaacctgctcaagtctgggaattgattgagaggccgtgactctgtttttattattcaggttagacttttgttcacttgacctagaacttttccacttatgcagttcaagaatttggtaggcattctatctatatcacatctaggaacactataatctactagccaacaccataggtctgtgcaagtcatactattctaactgctgctttgactctgctgtcccttatggtaaccacacttaccttgcctttggcagttgagtgctgcccattggccccttccaccccaggatccaattattcccattgtatttaggttttctaattcagtgactgcaggtcctgctgtaaggtgtcacctacagagaagagtgatcacagagcccttcaaggatgctgaggttcccctcacaaatttattcctcaaagtaatagtgagatctgtgtcttctgaactctcccagtgttggtgagtatgtcttaaatgacaaattcactctagcatttcaatctcctttcttctacattaaaccagggcaagtctgaaatttctagtttgctcactgtgggccatcttttggtctgtgtttcagccaaccaattaaactgttagaggccttcctaattccctgagatgcaacattaagtccagaatctctgcttagtgggcccatgtcaataaatttggcctaatccaactttacgtgccttccaccgttatctcacatccttagtacccattcctatacatattctctggattcctgcttgtgtaaattagaaaactcaagtcatgattttggagtgtagtgcaccttgtcatgggtcaccttcatacctcacctcgcctgctgggacttgagtgtagttatagatctaataacaaagaggggtggtagggtgggtcctgaaggaatcagcattatcttgcatggcagttgcctcaggggaagccattacagtttcctcaggcagtgcagggttaatccacttagactggagtagagatactgccaccacagggctggagagaaaactttcactgacaaagaagactcatcaatatttaggagctcaatgtccccagcttaatcagggtcttccacacatacctaatccaacttgtagtgccccattctttcccaatcactgcccttgctttaacagtagacaccctgcaaagctgggagtttggcttgctttgtaattcagttagtcacaggatgagatttggcatttgattttcagcaatctcagctctgtggctacagtagataagggtctccttcagggcatacatagaatctgtcaagtcatttatgcagctcttgagctgggaattcaaattcctgagctcctccttttctttcatcactttttccagcaacattaggagcaaccgactaatcccatcatattcattagtttgacaaatatgttcacaagtgtcaatatacatagtcaccaagacccttgcttcttaaaagtagttgattaggagtatccaatggagatattttgcatatacatattttttgagatggagtctcgctctgtcacccaggccggagtgcagtggcatgatctcagctcactgcaacctccatctcccaggttcaagcgattatcatgcctcagcctcccgagtagttgggattacaggcacctgcctaatttttgtgtttttagtagagacagggtttcatcatgttggccaggctggtctcgaactcctgacctcaggtgatccatccacctcggcctcccaaagtgctgggattacaggcgtgagccaccgcgcccagcctggcctacatatttctattgccagatcatgccatggacaatttttactactgaaaatagtcattagtgtctttaaatttcatcaggttacagaaccaattccagaaatccaataacaaatttataaaatttatccttaaaattctgttcctttagaatcactcttggtgtgaaaatctgtattagtcatggttcccaaagaaacaaaaccagaaccaagaggagatacatacacacacacacacacacacacacacacaaggaattagctcatgtgattatggagtctgccaagtctcaagatctgcagggtgagttggcagcctagagaccccagagagctgattcgtagttccagttcaaagaccagcaggctacagacccagaaagagttaaaatgttttagttcgagcccaaaggcaggaaaaaaactgaagtcccagtttaaaggtagtcaaatagaaggaactgtctcttactaagaggacagtaagcctttttgttatatttaggccttcaactgattggataagttctacccacactggggagaacaatctgctttacttagtctaccaattcaaatgttaatctcaccaaaaaacactctcacagacacacataaaataaagtttaatcaaatatatgggcaccccatggcccagtcaagttgacacataaaattaaccaccataatgaggtatctagagcaggcaaattcataaagacagaaagtagaaaagaggttaccagggtcttggaatggggaagaaatggagagttatttttaatgagtacagagtttctgtttggggtgatgaaaaagttctggaaatggatagtggtaatgggtgcacaatattgtgagtatacttaataccactaaattgtacacttaaaaatgattaaaatggtaaattttatgtatattgtacaacaataaaaaaggctatatcactgacaatgcattgttgtatttagcaaagaaaggggaatctccagcctccccatcaacaaaaacccccacaaacttctattttaaaataatgagctgaaatcatagcggagaggtgaataatgagcaaatataaaaaggaagacctttcctcagacagaatgcccatattaatgttgttactggaagactaagccttgagcaaaatgcaaggagaactcagtgtgagaattctgcattgtcatgaatcccagaaggaagctagagaagttgcagataaatattatcctctggcacctggaagaaccattctcaacctactctagaaaaaaagcacctccagtttaggcctccaggattcctacatattaaaattataagatcacagacatagatcagcaaacatgcaagacaacaagacaacttgagtacaagtgaacagaaacaatcaattcagatttaaaacttgaagaacaccagatattgacattatcggatacataatatgaaataattatgtataaaatctttaaagtaataacatatggaaacatgaaaataaaagacaaattatccaacattattaggcagttgaaaaaaaccattgcaggttacaaagtcaacatgcaaaaatcaattgtatttttatatactaacaattacaaatatgaaaaggaaaacagaaaagtctatttacaatagcatcaaagataatacaatatttaggaataaatttaacgaaggaggtgcaagtcttgtccactaaaaacaaaaaaacccagttgaaagaaactaaagaactgtctggtctgaagacagcaaatatggaaaattagcaactagaaaaaaattaaaaattaaaaattaaaagagaaattaaataactaaataaatgaaaaggcatcctggatttatggatttgaagacataatattcttaagataagaatattaccacaaaccatttgcagattcaaagcaagcattctgggtttttttgtttgtttgtttgttttttgatttgagacggagtctcactctgtcgctcaggctgcagtgtggtggtgcaatctccactcaccataacctctgcttcctgggctcaagcgattctccggcctcaaagcattctctatcagaatcccaaagacatttttttttttgaggaatagaaaaatctatcctaaaattcagatggaatttcaagggaccctgaatagccaaaacaatcttgaaaaagaacaacgttggaggagtcatacttcccaatttcagaacttactacaaagctacaagaatcaaaacagggcagtacttacataaatatagacacatagatcaatggaatagaattgagagtccagaaataagcctatacatctatggtcaattgattttcaataaaagtgccaagaccattttgtgggaaaagaatagtctcttcaacaaatggtgctgggacaattggatatccacatgcaaaagaatgaagttggatctttaccatatacaaaatttaactcaaggctggatgtggtggctcacatctgtaatcccagcactttgggaggctaaggctggtggatcacttgagctcaggagtttgagaccagcctgggcaacacagtgagactctgtatctacaaaacaagaaaaaaaaattagctggcatgatggtacacacctgtagtcccagctactagggaagctgggataggaggatcgcttgagcccaggaggtggaggctgcagtgagccatgatcgcaccactgcactccagcctgggtgtcagagcaagaccctgtctgtaaaaaatcatttaactaaaaatgtatcaaaaaactaaatataaaagctaaaaccataaaactgtaagaaaaaacaaagaggtaaattgttatgatactggatttggcaatggtttcttagatgtgacaccacaatcacaagcaacaactctataaaaatatatatagtaggcatctttaaagttaaaagcttttgtacatcaaagaacactatcaagaaagtaaaaagatgatctacagtataggagaaaaaaattgcaaatcatatatctgataaagggcctagtatcccagaatataaaaagaactcttacaactcaacaacagaaagacaaccaaattttaaaatgggtaaaggacttcaatggaacttctccaaagaagatatacaaggatccaacaaactcatgaaaagatagacaacatcattagttattagggaaatgcaaatcaaaaccacaatgagatagcatttcaaacctgctaggatggctaaattaaaaaaaaaacaaaaacaaaatgtcaagcgggaaaataacaagtgttagcaagaatataaagaaattggaaccttccttgatgatgagaatgtgaaatagggcagccactgtagaaaatattttggcagttcctcagtaaggaaaacatagaattaacatagacccagcaattctactcctgggtgtggacccaaaagaattaaaagcaggcactctaacaaaaactaatatacaaatgcatatagaagtactattcataatagcaaacaggtgaaaacaattcaaatgttcatcaagtgatgaacagataaacaaaatgtggtctatccatatatggactattatttattcataaaaaatcaaagtactgatccatgctaaaacatggatgctccttgaaagcattatgctaagtgaaagcagccaggcacaaaaggccacattccacttatatgaaatacccagaatagcaaatccatagagacagaaaacagattagtggttgccagaagctggcagaaggagtgaatgtggagtggcttcttaataagtattgaatctccttttggggttatagaaatgttctggaactagatagtggtgatggctatataacattgtgaatgtactaaatggcactgaacttcacactttaaaattgttaaaatggtaaattttatgtttgcgaattttgcaatagataagtcagaagacatgtacattaccataatgagtaacaaactgacagctgatttctaaataatagcaaatatcagaaaataatgaatgatgtcttcacaatgctaaaataaacaatgtgaacccctctctcaaaaagaaaacctaatgaaaatatcttttatgcgttaaagcaaaagaggaaattaggacacagacaggcacagagggacgaccacatgaagatatagaaagaggacagacacctacaagccaacgagagaggccttacaagaaaccaacccttagccaggtgtggtagtgtgcacttgtagttcttgttacaagggtgcagtgagctagggttgtgccactgcactccagcctgggaaacagaacaagaccctgcctctaaaaaaaaaaataaagagaaggagaagaagaagaaaaggaaaagaaaaaaaaaaagaaccaagcctgctggccaggcgtggtaactcatgcctgtaatcccagcactttggaaggctgaggcaggaagatcatctgaggtcaggagttcaagaccagcctgcccaacatggtgaaacccccctctactaaaaatacaaaaattagctggacatgctggcatgcgcttgtaatcccagctactcgggaggctgaggcacaagaattgcttgagcccaggaggcagaagttgcagtgagcccagatcgcgccatcacattccagcctggactacagagggagactccatctcaaaaaacaaacagacaaaaaaaaaatacacacacacacacacacacacacacacacacacacaaaacaagcctgcctaccccttgatcttggacttgtagcctccagaactgtgagaaaataaatttctattgtttaagccaggtgtgcgtgtgaaaatttagaacatatgacaacagcaaaaaagtcagcatgtggataaatagaataaaggattctaaaatccatgtattatctaggaggtaaagatgttaatattaaaccttcataatttgattaatgttgtagtttataggatagccagtaagtaatagaaatacacacaatgtaagactcccaaaatggtagaagaaaaaatatgaaaggataaaatatactcaacaaacctaaatgaaagcaagcaaagagagataaagaaacataaaacaggtaggaaaaatagcaagataagatggtatatttaaattgaaatataacagtaatcatatgtaatatgaatggaccaaatatttcagttaaaagacaaagattgtcagattgataaaaaagcaaaagtagctgggtgtgatggctcacacctgtagtcccagctacttaggatgctgatgtgggaggatcacttgagcccaggaggttcagcctggacaagatagtgagacttgtctctttaaaaaaaaaaaaaaaaagcaaaagtaaattgtgtgcattttatgagtcatatctaaaacattagatacagaaaagtagcaagacaaaaatgggaaaagaaattatgcaaatatctaaaagatatcgattacagctctattgatagcagaaaaatagactttaaagcaagaaagtattgctgaagattaagaatgtgatttcatggctggacgcggtggctcacacctgtaatcccagcactttgggaggccgaggcaggtggatcatgaggtcaggaaattgagaccatcctggctaacatggtgaaaccccgtctctactaaaaaaaaatacaaaaattagccgggtgtggtggcggacacctgtagtcccagttactcaggagggtgaggcaggagaatggcgtgaactcgggaggctagattttaacacatctctcgtcaattgatggaacaatgtatagaaatagaacaattaacatgattcacaagtttgatcttatagacatatttagaaaatagcaccttgaaattgcaaaattacaagggtggttccaacatggccgaataggaacagctccagtctacagctcccagcatgaatgacacagaagacaggtgatttctgcatttccaactaaggtaccaggttaatctcactgtggcttgtcggacagtgggtgcaggacagtgggtgcagcccaccgagcatgagccgaagcagggtaaggtatcacctcacccgggaagcacaaggggtcagggaattccctttcctagccaagggaagctgtgacagatggcacctggaaaattgggtcactcccatcctaatactgcgcttttccaatggtcttagcaaacggcacaccaggagattatatcctgcacctggctcagagggtcccacacccacggagcctcgctcattgctagcacagcagtctgagatcaaactgcaaggtggctgcaaggcagggagaggggcacccgccattgctgaggcttgagtaggtaaacaaagcggccaggaagctcgaacttggtggagcccaccgcagctcaaggaggcctgcctgcctctgtacgctccacctttgggggcagggcaaagacaaacaaaaagacagcagtaacctctgcagacttaaatgtccctgtctgacagctttgaagagagtagtggttctcccagcacagagtttgtgatctgagaacggacagactgcctcctcaagtgggtccctgacccccgagtagcctaactgggaggcacgccccagtaggggcagactgacacctcacacagctgggtacccctctgagaccaagcttccagaggaacgatcaggcagcaacatttgctgttcagcaatattcgctcttctgcagcctctgctgctgatacccaggcaaacagggtctggagcggacctccagcaaactccaacagacctgcagctgagggtcctgtctgttagaaggaaaactaacaaacagaaaggacatccacaccaaaaccccatctgtacatcaccatcatcaaagaccaaaggtagataaaaccacaaagatggggaaaaaacagagcagaaaagctgaaaattctaaaaatcagagtacctctcctactccaaaggaacgcagctcctcgccagcaacggaacaaagctggacagaaaatgactttgacgagttgagagaagaaggcttcagatgatcaaacttctctgagctaaaggaggaagttcgaacccatcacaaagaagctaaaaaccttgaaaaaaaaggttagatgaatggctaactagaataaccagtatagagaagtccttaaatgacctgatggagctgaaaaccatggcacgagaactatgtgacgaatgcataagctttagtagccgatgcgatcaactggaagaaagggtatcagtgattgaagatcaaatgaatgaaatgaagcgagaagagaagtttagagaaaaaagaataaaaagaaatgaacaaagcctccaagaaatatgggactatgtgaaaagaccaaatctatgtctgattagtgtacctgaaagtgacagggagaatggaaccaagttggaaaacactctgcaggatattatccaggagaacttccccaacctagcaaggcaggccaacattcaaattcaggaaatacagagaacgccacaaagatactccttgagaagagcaactccaagacacataactgtcagattcaccaaagttgaaatgaaggaaaaaatgttaagggcagccagacagaaagttcgggttacccgcaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcttgccctacaagagctcctgaaggaagcactaaacatagaaaggaacaaccggtaccagccactgcaaaaacatcccaaattgtaaagaccatcgatgctaggaagaaactgcatcaactaatgagcaaaataaccagctaacatcataatgacaggatcaaattcacacataacaatattaaccttaaacataaatgggctaactgctccaattaaaagacacagactggcacattggataaagagtcaagacccatcagtgtgctgtattcaggagacccatctcacatgcagagactcacataggctcgaaataaagggatggaggaagatctaccaagcaaatggaaaacaaaaaaagaaaagcaggggttgcaatcctagtctctgataaaacagactttaaaccaacaaagatcaaaagagacaaggccattacataatggtaaagggatcaattcaacaagaagagctaactatccaaaatatatatgcacccaatacaggagcacccagattcataaagcaagtccttagagacctacaaagagacttagactcccacacaataataatgggagactttaacaccccactgtcaacattagacagttcaacgagacagaaagttaacaaggatatccaggaattgaactcagctctgcagcaagcggacctaatagacatctacagaactctccatcccaaatcaacagaatatacattcttctcagcaccacatccaaaactgaccacatagttggaagtaaagcactcctcagcaaatgtaaaagaacagaaattataacaaactgtctctcaggccacagtgcaatcaaactagaactcaggattaagaaactcattcaaaaccgctcaactacatggaaactgaacaacctgctcctgaatgactactgggtacatagcgaaatgaaggcagaaataaagatgttctttgaaaccaatgagaacaaagacacaatataccagaatctctgggacacatttaaagcagtgtgtagaggaaaatttatagcactaagtgcccacaggagaaagcaggaaagatcaaaaattgacaccctaacatcacaatttaaagaactagagaagcaagagcaaacacattcaaaagctggcagaaggcaagaaataactaagatcagagcagaactgaaggagatagagacacaaaaaaccctttaaaaaatcaatgaatccaggaactggttttttgaaaagatcaacaaaattgatagaacactagcaagactaataaagaagaaaagagagaagaatcaaatagacgcaataaaaaatgataaaggggatatcaccaccaatcccacagaaatacaaactaccatcagagaatactataaacacctctatgtaaataaactagaaaatctagaagaaatggataaattcctggacacatacaccctcccaagactaaaccaggaagaagttgaatccctgaatagaccaataacaggctctgaaattgaggcaataattaatagcttaccaaccaaaaaaagtccaggaccagacggattcacactcaaattctaccagaactacaaggaggagctggtaccattccttctgaaactattccaatcaatagaaaaagatggaatcctccctaactcattttatgaggccagcatcatcctgataccaaagcctggcagagaaacaacaaaaaaagagaattttagaccaatatccctgatgaacattgatgcaaaaatcctcaataaaatactggcaaaccaaatccagcagcacatcaaaaagcttatccaccatgatcaagtgggcttcatctctgggatgcaaggctggttcaacatacgaaaatcaataaacgtaatccagcatataaacagaaccaaagacaaaaaccacatgattatctcaatagatgcagaaaaggcctttgacaaaattcaacaacacttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgttcgcagacgacatgattgtatatctagaaaacaccattgtctcagcccaaaatctccttatgctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatatgaaggacctcttcaaggagaactacaaaccactgctcaatgaaataaaaggggatacaaacaaatggaagaacattccatgctcatgggtaggaagaatcaatattgtgaaaatggccatactgcccaaggtattttatagattcaatgccatccccatcatgctaccaatgactttctttacagaattctaaaaaactattttaaagttcatttggaaccaaaaaagagcccgcattgccaagtcaatcctaagccaaaagaacaaagctggaggcatcacgctacctgacttcaaactatactacacggctacagtaaccaaaacagcatggtactggtaccaaaacagagatatagaccaatggaacagaacagagccctcagaagtaataccacacatctacaaccatctgatctttgacaaacctgacaaaaacaagaaatggggaaaggattccctattgaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagccaaaattgacaaatgggatctaatgaaactaaagagcttccgcacagcaaaagaaactaccatcccagtgaacaggcgagctacaaattgggagaaaatgtttgcaatctattcatctgacaaagggctaatatccagaatctacgaagaactcaaacaaacttacaagaaaaaaagaccccatcaaaaagtgggtgaaggatataaacagacacttctcaaaagaagacatttatgcagccaacagatacatgaaaaaatgctcatcatcactggccatcagagaaatgcaaatcaaaaccacagtgagataccatctcacaccagttagaatggcgatcattaaaaagtcaggaaacaacaggtgctggagaggatgtggagaaataggaacgcttttacactgttggtgggactgtaaactagttcaacaattgtggaagacagtgtggcgattcctcaaggatctagaactagaaataccatttgacccagccatcccattactgggtatgtacccaaaggattataaatcatgctgctataaagacacatgcacacgtatgtttattgcggcactattcacaatagcaaagacttggaaccaacccaaatgtccatcaatgatagactggattaagaaaatgtggcacatatacaccatggaatactatgcagccataaaaaggatctgttcatgtcctttgtagggacatggatgaagctggaaaccatcattctcaaaaactatcacaaggacaaaaaaccaaacaccgcatgttctcactcgtaggtgggaattgaacaataagaacacttggacacaggtaggggaacatcacacaccggggcctgtcatggggtgggtggacaggggagggatagcattaggagatatacctaatgtaaatgacgagttaatgggtgcagcacaccaacatggcacatgtatacatatgtaacaaacctgcacgttgtgcacatgtaccctagaacttacagtataataaaaaaaaagaaattgcaaaattacacattctttgtaagcacacaaaggaaacatgttagaattttccattttaagctacaaataagctacaaataaagtagtctcaaatttcagataatataaaacatgttttctggtcacaatacaattaaagttgatataaataagaaagataactataaaatcttcctatgttagaatcaagaactatacttttaaacccatgtgtcaaataagaaatcataaattagaaaatattttaaactgaatgataacaaggcatgacatattaaaatgtgggaatcagctaaagcaatatttagaaagaaatgtatagcgttaaaaacatatattggaagagaagaaagcctgacaattaatgagctaaggtatgtctcaagaagctagtgaaacagcaaaataaaccaaaaggaagtagaagcaaggaaataataaagatatgaagtaaatgaagtaaaaaagaaacatacaatagagagaataaagaaaaccaaaagttggttccttgaaaattgacaaacttctggcaagagcaatcaagatgaaaagaaggcacaaataatatcagaaactttaaaaaactggacatcaataaagatcccacaaaaatttctgccaatataaaaatataaaaaatgaggatacttattaatattaaatgttctttcttgttgtatttaccagggattaatccattttacctaattttccaaacttagtgttaaaaggttattaatttaaaaaatccagatccagatggctacactaactatattctaccaatttttcaaaggagaaataatattaaccttgcaaaaattctttcagaaaatggaaaaagatggaatgttattcaattatcttatgataatagcataaccttgacaaccaaaccgaacaagaacaatattagaaaggaagataataggcccgttttattcataaacataaatcccaaacaaaatattagcaatatggatccaaattggatttatgctaggaatgcaagtttggcttatacattagaaaactgatataatttatcacagtgacagactgaaggattatacatattggctgtcctaagcagtgcaataagatgagaaaaagaaggaaaatatgtaaggattgaatatgatgaaacaaactcattgtatgtggaagatatgatggcatagatagaaaatccaaaggaatttatatataaattattagaatttttaaaatttttcaagcttgctgaaaacaaaataaataccaaaattaattgtatttctgtatacctgaaacagttggaaaaatagttttaaatagcatttaaaaattccaagcaggagttgcacattcctgtcagataatggcagctgcctaaatctctccacagtcttcaaaaaccatacatacacatacacacacaattttaaattatgactaaaaccacccataacccatctatagaataaccagaagacaaaaagtactataagtttatatttacaagtagaaaataaatatataaatctagccaaccttgctccagagagaaaccctgtctcaaaaaaaaaaaaaaaaaaaaaaagaagaaagcaaatgttggaaattaactgtcctataaaaacaaaagtgaattactaaatcacaagacccacaaacctctttggtcacatctattaaataaattacacttccatttatcaacagtagagggtactcctggctaagaaacctagtaagccacccagccctcatgtctgcctgcataaatcacctcttattgctgaaacaagaaaatgtaaggaatttctaaatgaacagaaaatagcatatgaagcagatggtattaatgttcttgagtttttattccctctttccttgaaaacctcatcaactttaggcatggccgtacggctcatcttgatcaatagaatgtgattggacatgacatatataccacttccaaatagaagctttaaatgtgattttgtgtttgacacactcttttgtgcctctgctccaggctccagactttaagcctctagaacgataagtgaataaatttcttttgttttaaaggcaccaagtgtgtggtgaatttgttacagtagccctagaaatctaatactaacaaaaagaatgttagagttgaattagaagtgtcagtgagaacttaggaatttaaaaaatcatattcttagcactgttcactgagggaatctagaagtaattacactgcagtaataacgagcccatcccatgcccaaatcttggtctctaactaccattttccagtcaaaagaatctgagctccctagagaaatgactttttcaaggctggatcaaggaaactgccaggcaatcttagatgatcttggtgatcttgatgtgccagaagattaatgggatcatgtgaaaagaacacagaaactggtctgaagggcttcctgttggccagatttgagacaatttgagcatcaaaaggaataatgagggtaatggatcataactggaaaatcagtttgcaaccatcaatgtacttactattgaatacttgtaaagaactttaagggttgctaataccattggataaaagcttgttgtgaaacagaatatttgcatggtctcaaagtctcactccacagattgttaggaaagggaaagggttacctttataaatatagagattaggtggacatcttaaccaagtgatcaaacttagcatcatcaataatgggacaatctggcatcgcatgccccctgatttaatgcagtaaggattaagtctaacaaaagatgtacaaagcctccaaatacagcgtaaacatttgtaaaataatctcagaacagggaccttaatgtttctcaaaaatttttccaaatacagaactttatttctatagatgtttatggtatatttgccatgctatatacattatgctatatattctatgtgctgaagatacaacaatgaccaaggtctttgcccttgtggaactgacatttggtggcggagacagaggaaacagtcaataagcatgtaaagagataaaggaaaagatactgaatgctacaaaggaaacaaataagttgagatttagaacaaaaaagagtcctattttacaagaggaataatgaggaagacctttctaaagaggtagctcagcactttgggaggccgaggcgggtggatcacgaggtcaggagatcaagaccatcctggctaacacagtgaaaccccatctctactaaaaatacaaaaaatgagccgggcatggtggcgggcacctgtagtcccagctacttgggaggctgaggcaggagaatggcgtgaacccgggaggcggagcttgcagtgagccgagatggtgccactgcactccagcctgggcgacagagcgagactccgtctcaaaaaaaaaaaaaaaaattgaggcagaatttcgctatgttgcctaggcttgtctcaaactcctgggctcaagcaatcctcctgcctcagcctgctgagtagctgggactccaggggcatgccactatgcttagtttaagaggtggtatttaaactgagacccgaagggtaaaaaacatggataaaagaagaaacagaaggggtaagagccttccaagcagagggaatcacatatacaaaggctctcatgttaaataaaacaagagttgacattgttgagaaactgaaagatcagctcatctgcgatgcggtaaaataggaggaatgcagtgggagaacagatcagagacttgggcaggggctatattaggcagaacttggagaccagagtaagggggccaaggtgggaacagaccgattaaattggcatctcttgggggggtgggggggtggggaacttacccatgcatcattttttaaaagctccaaaggcgattccaataagcagccagggttgggaacctagggggaaaatgtagctagatgaatgaagatggcccaaacgtcttttgttctgatagctaaactctctgtaggatcacagtgttacttcacagtgcatttgccaggaaaagtctcttcccatttggaatccgaagtaaaactgacaccacacttgaagatgccaggattgttagaggaaaatgtcacccaatagctccaggaagcaggagccctactgttgctgtttaaccacttctttcccattttggtggcaagttgcctccttttacacaaactgcctcaggagatcctaaagatatcatggtgtctgtctgtccttgcaagagcatgcattatggtaggacattgccttcattctgttcctttttctccaagactcttgcttattctcaccatttggctggactttctactgtaggattacctcggaatccacacaaaacccacagggtttcagagttgccttgaattacacgttttgaacattcagatcttcattttcccaaacatccacccagttataggtgacctttgctccaaagtcctggagtagcaaggtgccttgagtcttagactcttcccacttctttctctcttctgcatcccctcctgccaaggttgcccagccacactaaattgcatgccttgctgtgttgcattcgttatcattctaaagttgtcaccaacatgtgcgaaaccagtttatctaataacgatagctaccattttctgagctcttgccatgtactcctcttgccacagcaaatgcattgacaagggagtctgctggccaaagcctgactctcatctccagatggtccaacacagatgctgtgtgtgacccaggacaaagcacttaatgtcactgaggtttgggaagtgggtgagaacactgtagatataaggcctagctagagtgaaggcctccaaagcagggtgctcttaattctagatgtcccagatgcgtaggacagagtcatctagtcatcttccagggtttaatcctggactactggaaacaactagaagtgagaaaagcgtctgtgctttgcagtgaccattgtcctgtcagacaaccaataaatgctatctttcctctttcaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactgagggtggccactgcagcacctgccactgccgtcacctctccctcctcagctccagggcagtgtccctccctggcttgccttctacctttgtgctaaatcctagcagacactgccttgaagcctcctgaattaactatcatcagtcctgcatttctttggtggggggccaggagggtgcatccaatttaacttaactcttacctattttctgcagctgctcccagattactccttccttccaatataactaggcaaaaagaagtgaggagaaacctgcatgaaagcattcttccctgaaaagttaggcctctcagagtcaccacttcctctgttgtagaaaaactatgtgatgaaactttgaaaaagatatttatgatgttaacatttcaggttaagcctcatacgtttaaaataaaactctcagttgtttattatcctgatcaagcatggaacaaagcatgtttcaggatcagatcaatacaatcttggagtcaaaaggcaaatcatttggacaatctgcaaaatggagagaatacaataactactacagtaaagtctgtttctgcttccttacacatagatataattatgttatttagtcattatgaggggcacattcttatctccaaaactagcattcttaaactgagaattatagatggggttcaagaatccctaagtcccctgaaattatataaggcattctgtataaatgcaaatgtgcatttttctgacgagtgtccatagatataaagccatttggtcttaattctgaccaataaaaaaataagtcaggaggatgcaattgttgaaagctttgaaataaaataacaatgtcttcttgaaatttgtgatggccaagaaagaaaatgatgatgacattaggcttctaaaggacatacatttaatatttctgtggaaatatgaggaaaatccatggttatctgagataggagatacaaactttgtaattctaataatgcactcagtttactctctccctctactaatttcctgctgaaaataacacaacaaaaatgtaacaggggaaattatataccgtgactgaaaactagagtcctacttacatagttgaaatatcaaggaggtcagaagaaaattggactggtgaaaacagaaaaaacactccagtctgccatatcaccacacaataggatcccccttcttgccctccacccccataagattgtgaagggtttactgctccttccatctgcctgaccccttcactatgactacacagaatctcctgatagtaaagggggctggagacaaggataagttatagagcagttggaggaagcatccaaagattgcaacccagggcaaatggaaaacaggagatcctaatatgaaagaaaaatggatcccaatctgagaaaaggcaaaagaatggctacttttttctatgctggagtattttctaataatcctgcttgacccttatctgacctctttggaaactataacatagctgtcacagtatagtcacaatccacaaatgatgcaggtgcaaatggtttatagccctgtgaagttcttaaagtttagaggctaacttacagaaatgaataagttgttttgttttatagcccggtagaggagttaaccccaaaggtgatatggttttatttcctgttatgtttaacttgataatcttattttggcattcttttcccattgactatatacatctctatttctcaaatgttcatggaactagctcttttattttcctgctggtttcttcagtaatgagttaaataaaacattgacacatacaaacaaatgcctttgagaattgtgtttttacactggaaataaaaatgtgaacactgatttttaaaacaaataggggcactgaatagcaagatggacactctagaaaaccaaattagtgagttagaaaaccagattaaattgaactcagagtaaaaatgatataattcatgagagtctgaataaaataaatcagaaatggagcctcaatccaggagaacagcttatatggagagagagagactgagagagaaatgggagtttctgttcaatgggcataaagtttcagctatgctgctgggcacagtggctcatgcctgtaatcctggcactttgggaggccaaggcgggcggatcacctgaggtcgggagttcaagaccagcctagccaacatggcgaaatcccgtcgctaataaaaatataaaaattagttgggcatggtggcacatgcctgtagtcccagctacttgggaggttgaggcacaagaatcgcttgaacccgggaggcgggtggaggttgcagtgagccaagatcgtgccgttgcattccatcagcctgggcaacagagtgagactccatctcaaaaaaaaaaaagtttcagttatgcaagatgaattaagttctacagatctaatgtacaacattgtgcatatagctaacgataccatactgggcacttaaaaatttgttaagagagcagataccacgttgtgttcttactacagttttacaacaatgcaaaaatgcattgtaaacactatgtgcaaatagaatagcaaagaatgtatacagtgcccatgagcataacattctagtggacccacaatgcatcagagttcagtgagactcaaagggagaagaatgttggcaaagtcagtggggaggagaaaatgagtgtgatgaaataggcggtctcattaaacttcccttacaaaacacaagatcaaagataaaattattaagaatttcgagacagtgacatcagagcaaacgaaacatagg

SEQ ID NO: 7 - DNA, 7053 bp, Artificial Sequence
  synthetic construct
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctac

SEQ ID NO: 8 - DNA, 7053 bp, Artificial Sequence
  synthetic construct
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgagggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctac

SEQ ID NO: 9 - DNA, 7053 bp, Artificial Sequence
  synthetic construct
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgagggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacagtgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctac

SEQ ID NO: 10 - DNA, 7053 bp, Artificial Sequence
  synthetic construct
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccatcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgagggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctac

SEQ ID NO: 11 - DNA, 7053 bp, Artificial Sequence
  synthetic construct
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacagtgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctac

SEQ ID NO: 12 - DNA, 7053 bp, Artificial Sequence
  synthetic construct
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacggaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgagggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctac

SEQ ID NO: 13 - protein, 2351 aa, Artificial Sequence
  synthetic construct
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 14 - protein, 2351 aa, Artificial Sequence [sequence omitted]

SEQ ID NO: 15 - protein, 2351 aa, Artificial Sequence
  synthetic construct
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYEGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTVKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 16 - protein, 2351 aa, Artificial Sequence
  synthetic construct
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVHPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYEGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 17 - protein, 2351 aa, Artificial Sequence
  synthetic construct
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTVKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 18 - protein, 2351 aa, Artificial Sequence
  synthetic construct
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHGTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYEGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 19 - protein, 2332 aa, Artificial Sequence
  synthetic construct
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 20 - protein, 2332 aa, Artificial Sequence
  synthetic construct
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYEGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 21 - protein, 2332 aa, Artificial Sequence
  synthetic construct
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYEGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTVKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 22 - protein, 2332 aa, Artificial Sequence
  synthetic construct
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVHPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYEGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 23 - protein, 2332 aa, Artificial Sequence
  synthetic construct
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTVKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 24 - protein, 2332 aa, Artificial Sequence
  synthetic construct
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHGTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYEGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 25 - DNA, 19 bp, Artificial Sequence
  synthetic construct
aatcaagcaagcagaccat

SEQ ID NO: 26 - DNA, 17 bp, Artificial Sequence
  synthetic construct
ggccaacagctggagaa

SEQ ID NO: 27 - DNA, 27 bp, Artificial Sequence
  synthetic construct
tacaaaggacggacatcagtgattccg

SEQ ID NO: 28 - DNA, 35 bp, Artificial Sequence
  synthetic construct
atcgagggaatatttaccttttggtaatctccttg

SEQ ID NO: 29 - DNA, 21 bp, Artificial Sequence
  synthetic construct
cagaattcaagacaccctagc

SEQ ID NO: 30 - DNA, 18 bp, Artificial Sequence
  synthetic construct
ctctgtcgcaagagcatc

SEQ ID NO: 31 - DNA, 35 bp, Artificial Sequence
  synthetic construct
agtcttctctatgtcattttctggaattgtggtgg

SEQ ID NO: 32 - DNA, 20 bp, Artificial Sequence
  synthetic construct
ttccgtgtgcaaaccaaggg

SEQ ID NO: 33 - DNA, 21 bp, Artificial Sequence
  synthetic construct
gcctcagatacatacagtgac

SEQ ID NO: 34 - DNA, 29 bp, Artificial Sequence
  synthetic construct
tgttctatttgttgaatcatttaatgacc

SEQ ID NO: 35 - DNA, 35 bp, Artificial Sequence
  synthetic construct
cttttcttactgagcactaggcaaaatgtagaagg

SEQ ID NO: 36 - DNA, 23 bp, Artificial Sequence
  synthetic construct
catatgacggggcatatgctcca

SEQ ID NO: 37 - DNA, 17 bp, Artificial Sequence
  synthetic construct
aatggtgaccaagaggc

SEQ ID NO: 38 - DNA, 22 bp, Artificial Sequence
  synthetic construct
gatgaggaactccttcacatac

SEQ ID NO: 39 - DNA, 35 bp, Artificial Sequence
  synthetic construct
ccactcttttggattattcacctgagggcaataga

SEQ ID NO: 40 - DNA, 28 bp, Artificial Sequence
  synthetic construct
tttcactgtcttctggaagtccacttgc

SEQ ID NO: 41 - DNA, 20 bp, Artificial Sequence
  synthetic construct
ctcacggaatcactgatgtc

SEQ ID NO: 42 - DNA, 22 bp, Artificial Sequence
  synthetic construct
gtaatctccttgaatacaaagg

SEQ ID NO: 43 - DNA, 19 bp, Artificial Sequence
  synthetic construct
tgacccttggtttgcacac

SEQ ID NO: 44 - DNA, 22 bp, Artificial Sequence
  synthetic construct
tgtattttaggcataggtgttc

SEQ ID NO: 45 - DNA, 23 bp, Artificial Sequence
  synthetic construct
caaaatgtagaaggttcatatga

SEQ ID NO: 46 - DNA, 21 bp, Artificial Sequence
  synthetic construct
ttgaagtactggagcatatgc

SEQ ID NO: 47 - DNA, 20 bp, Artificial Sequence
  synthetic construct
aagtggacttccagaagaca

SEQ ID NO: 48 - DNA, 21 bp, Artificial Sequence
  synthetic construct
tagttactcctgtgactttca

SEQ ID NO: 49 - DNA, 20 bp, Artificial Sequence
  synthetic construct
ttatcaaaggggcttcttgc

SEQ ID NO: 50 - DNA, 19 bp, Artificial Sequence
  synthetic construct
catgccctttctcctgacc

SEQ ID NO: 51 - DNA, 20 bp, Artificial Sequence
  synthetic construct
agcaagtgttgaggtccagg

SEQ ID NO: 52 - DNA, 20 bp, Artificial Sequence
  synthetic construct
tgaagtagcaaaagggaggc

SEQ ID NO: 53 - DNA, 20 bp, Artificial Sequence
  synthetic construct
cttctccatccctctcctcc

SEQ ID NO: 54 - DNA, 20 bp, Artificial Sequence
  synthetic construct
cagaaatgtttctttggggc

SEQ ID NO: 55 - DNA, 20 bp, Artificial Sequence
  synthetic construct
cttcaaatttgcctccttgc

SEQ ID NO: 56 - DNA, 20 bp, Artificial Sequence
  synthetic construct
agaccaagcagaggaagacg

SEQ ID NO: 57 - DNA, 20 bp, Artificial Sequence
  synthetic construct
aatcttgcctcagagcaacc

SEQ ID NO: 58 - DNA, 20 bp, Artificial Sequence
  synthetic construct
gaaaagcaattcctaggggg

SEQ ID NO: 59 - DNA, 20 bp, Artificial Sequence
  synthetic construct
gggcaacagagtgagactcc

SEQ ID NO: 60 - DNA, 20 bp, Artificial Sequence
  synthetic construct
ttctggaactcagctcctcc

SEQ ID NO: 61 - DNA, 20 bp, Artificial Sequence
  synthetic construct
ggagacctgacatcaaagcc

SEQ ID NO: 62 - DNA, 20 bp, Artificial Sequence
  synthetic construct
aaccccatctccttcattcc

SEQ ID NO: 63 - DNA, 20 bp, Artificial Sequence
  synthetic construct
taaggtgtgagcacactggg

SEQ ID NO: 64 - DNA, 21 bp, Artificial Sequence
  synthetic construct
cgatgagttctgttctgagcc

SEQ ID NO: 65 - DNA, 20 bp, Artificial Sequence
  synthetic construct
atggtgattggtgaccttgg

SEQ ID NO: 66 - DNA, 20 bp, Artificial Sequence
  synthetic construct
ggaaactaggggatcttggc

SEQ ID NO: 67 - DNA, 20 bp, Artificial Sequence
  synthetic construct
gtcttgctcctgctttcacc

SEQ ID NO: 68 - DNA, 20 bp, Artificial Sequence
  synthetic construct
tacccttgccatttgattcc

SEQ ID NO: 69 - DNA, 20 bp, Artificial Sequence
  synthetic construct
ctgctgaagaggaggactgg

SEQ ID NO: 70 - DNA, 20 bp, Artificial Sequence
  synthetic construct
atgtccattggagacaaggc

SEQ ID NO: 71 - DNA, 20 bp, Artificial Sequence
  synthetic construct
gattgtggtatctgcagggg

SEQ ID NO: 72 - DNA, 20 bp, Artificial Sequence
  synthetic construct
caacagctggagaaaggacc

SEQ ID NO: 73 - DNA, 21 bp, Artificial Sequence
  synthetic construct
tgacactttcacagtcaaccg

SEQ ID NO: 74 - DNA, 20 bp, Artificial Sequence
  synthetic construct
cagcaggcacgtttactacg

SEQ ID NO: 75 - DNA, 20 bp, Artificial Sequence
  synthetic construct
cagtcaccctcttgtcctgg

SEQ ID NO: 76 - DNA, 20 bp, Artificial Sequence
  synthetic construct
gggaattaaaagggagaggg

SEQ ID NO: 77 - DNA, 21 bp, Artificial Sequence
  synthetic construct
cctgggaataagataatgggc

SEQ ID NO: 78 - DNA, 20 bp, Artificial Sequence
  synthetic construct
aaatgctggtgaggatgtgg

SEQ ID NO: 79 - DNA, 20 bp, Artificial Sequence
  synthetic construct
acagcagcaatgcaaaaacc

SEQ ID NO: 80 - DNA, 20 bp, Artificial Sequence
  synthetic construct
tctattgctccaggtgatgg

SEQ ID NO: 81 - DNA, 20 bp, Artificial Sequence
  synthetic construct
atgctcttgcgacagagtcc

SEQ ID NO: 82 - DNA, 20 bp, Artificial Sequence
  synthetic construct
aacaaagcaggtccatgagc

SEQ ID NO: 83 - DNA, 20 bp, Artificial Sequence
  synthetic construct
ttggcaaaaagtcatctccc

SEQ ID NO: 84 - DNA, 19 bp, Artificial Sequence
  synthetic construct
taattgctttggactgggg

SEQ ID NO: 85 - DNA, 20 bp, Artificial Sequence
  synthetic construct
ccaccagatgcacaaaatcc

SEQ ID NO: 86 - DNA, 20 bp, Artificial Sequence
  synthetic construct
tttgcttggtttgatttccc

SEQ ID NO: 87 - DNA, 20 bp, Artificial Sequence
  synthetic construct
gaaggttcatatgacggggc

SEQ ID NO: 88 - DNA, 21 bp, Artificial Sequence
  synthetic construct
atgactgctttcttggacccc

SEQ ID NO: 89 - DNA, 20 bp, Artificial Sequence
  synthetic construct
tctgaccagggtcctattcc

SEQ ID NO: 90 - DNA, 20 bp, Artificial Sequence
  synthetic construct
catgattgctttcacaagcg

SEQ ID NO: 91 - DNA, 20 bp, Artificial Sequence
  synthetic construct
attggatcctcttgcttggg

SEQ ID NO: 92 - DNA, 20 bp, Artificial Sequence
  synthetic construct
tgtccctgattcctctaccc

SEQ ID NO: 93 - DNA, 20 bp, Artificial Sequence
  synthetic construct
atgcaaaatgcttctcaggc

SEQ ID NO: 94 - DNA, 23 bp, Artificial Sequence
  synthetic construct
aaaagcttgttcaaaataaatgg

SEQ ID NO: 95 - DNA, 21 bp, Artificial Sequence
  synthetic construct
tctgtaccacttcttccaggg

SEQ ID NO: 96 - DNA, 20 bp, Artificial Sequence
  synthetic construct
tttatgccagtccaacctgc

SEQ ID NO: 97 - DNA, 20 bp, Artificial Sequence
  synthetic construct
tatttttggaaggtgggagg

SEQ ID NO: 98 - DNA, 20 bp, Artificial Sequence
  synthetic construct
cgaatcctttgatcctgagc

SEQ ID NO: 99 - DNA, 20 bp, Artificial Sequence
  synthetic construct
ttgatgagaccaaaagctgg

SEQ ID NO: 100 - DNA, 20 bp, Artificial Sequence
  synthetic construct
agagcatggagcttgtctgc

SEQ ID NO: 101 - DNA, 20 bp, Artificial Sequence
  synthetic construct
aagcactttgcatttgaggg

SEQ ID NO: 102 - DNA, 21 bp, Artificial Sequence
  synthetic construct
tggagatcttcgagctttacc

SEQ ID NO: 103 - DNA, 19 bp, Artificial Sequence
  synthetic construct
ggaccccagtttcttcagc

SEQ ID NO: 104 - DNA, 20 bp, Artificial Sequence
  synthetic construct
agtgggaagtggagaggagg

SEQ ID NO: 105 - DNA, 21 bp, Artificial Sequence
  synthetic construct
gtatgccataaagcctttatg

SEQ ID NO: 106 - DNA, 20 bp, Artificial Sequence
  synthetic construct
gttctaatcccagtagaagg

SEQ ID NO: 107 - DNA, 20 bp, Artificial Sequence
  synthetic construct
ccacagcttcacacacacat

SEQ ID NO: 108 - DNA, 20 bp, Artificial Sequence
  synthetic construct
tctatgagccttgacactac

SEQ ID NO: 109 - DNA, 20 bp, Artificial Sequence
  synthetic construct
ttcccacttcttcttggtgc

SEQ ID NO: 110 - DNA, 20 bp, Artificial Sequence
  synthetic construct
tgggcatttaggttgactcc

SEQ ID NO: 111 - DNA, 20 bp, Artificial Sequence
  synthetic construct
tcatgccactacactccagc

SEQ ID NO: 112 - DNA, 20 bp, Artificial Sequence
  synthetic construct
ctgcccataaccaaacttcc

SEQ ID NO: 113 - DNA, 20 bp, Artificial Sequence
  synthetic construct
gggtgacagagcaagactcc

SEQ ID NO: 114 - DNA, 20 bp, Artificial Sequence
  synthetic construct
aaaaggcttgggaatcaagg

SEQ ID NO: 115 - DNA, 20 bp, Artificial Sequence
  synthetic construct
agatgtcccagatgcgtagg

SEQ ID NO: 116 - DNA, 20 bp, Artificial Sequence
  synthetic construct
gctttcatgcaggtttctcc

SEQ ID NO: 117 - DNA, 20 bp, Artificial Sequence
  synthetic construct
tattttctgcagctgctccc

SEQ ID NO: 118 - DNA, 21 bp, Artificial Sequence
  synthetic construct
ctttcaacaattgcatcctcc

SEQ ID NO: 119 - DNA, 21 bp, Artificial Sequence
  synthetic construct
gaggggcacattcttatctcc

SEQ ID NO: 120 - DNA, 20 bp, Artificial Sequence
  synthetic construct
tcatagtgaaggggtcaggc

SEQ ID NO: 121 - DNA, 20 bp, Artificial Sequence
  synthetic construct
caccacacaataggatcccc

SEQ ID NO: 122 - DNA, 20 bp, Artificial Sequence
  synthetic construct
gtcaatgggaaaagaatgcc

SEQ ID NO: 123 - DNA, 20 bp, Artificial Sequence
  synthetic construct
caatccacaaatgatgcagg

SEQ ID NO: 124 - DNA, 20 bp, Artificial Sequence
  synthetic construct
agtgccaggattacaggcat

SEQ ID NO: 125 - DNA, 24 bp, Artificial Sequence
  synthetic construct
gaatttaatctctgatttctctac

SEQ ID NO: 126 - DNA, 22 bp, Artificial Sequence
  synthetic construct
gagtgaatgtgatacatttccc

SEQ ID NO: 127 - DNA, 23 bp, Artificial Sequence
  synthetic construct
taaaaataggttaaaataaagtg

SEQ ID NO: 128 - DNA, 23 bp, Artificial Sequence
  synthetic construct
tttaaatgactaattacatacca

SEQ ID NO: 129 - DNA, 20 bp, Artificial Sequence
  synthetic construct
tcagggttggttactggagc

SEQ ID NO: 130 - DNA, 20 bp, Artificial Sequence
  synthetic construct
acactaccatggtcttgggg

SEQ ID NO: 131 - DNA, 20 bp, Artificial Sequence
  synthetic construct
agtcagtgggcctgttatgg

SEQ ID NO: 132 - DNA, 20 bp, Artificial Sequence
  synthetic construct
gtccctagctcttgttcccc

SEQ ID NO: 133 - DNA, 20 bp, Artificial Sequence
  synthetic construct
tgggcagatagggatagtgg

SEQ ID NO: 134 - DNA, 20 bp, Artificial Sequence
  synthetic construct
tttgtgcgtttctcaacagc

SEQ ID NO: 135 - DNA, 20 bp, Artificial Sequence
  synthetic construct
cttctccatccctctcctcg

SEQ ID NO: 136 - DNA, 20 bp, Artificial Sequence
  synthetic construct
ctaattgctttggactgggg

SEQ ID NO: 137 - DNA, 20 bp, Artificial Sequence
  synthetic construct
atgactgctttcttggaccc

SEQ ID NO: 138 - DNA, 20 bp, Artificial Sequence
  synthetic construct
cgaatcctttgatcctgagg

What is claimed is:

1. A method for treating a hemophilia subject having a defective Factor VIII (FVIII) protein comprising:
    performing an assay to detect the FVIII haplotype of the hemophilia subject and selecting a hemophilia subject having a FVIII haplotype selected from H3, H4, H5 or H6, to provide a selected hemophilia subject; and
    administering to the selected hemophilia subject a FVIII replacement preparation comprising an effective amount of a FVIII protein, wherein the FVIII haplotype of the selected hemophilia subject and the FVIII protein of the FVIII replacement preparation are the same, and wherein the FVIII protein of the FVIII replacement preparation comprises the sequence as set forth in SEQ ID NO: 21, SEQ ID NO: 22, SEQ ID NO: 23, or SEQ ID NO: 24.

2. The method of claim 1, wherein the FVIII protein comprises the sequence of SEQ ID NO: 21.

3. The method of claim 1, wherein the FVIII protein comprises the sequence of SEQ ID NO: 22.

4. The method of claim 1, wherein the FVIII protein comprises the sequence of SEQ ID NO: 23.

5. The method of claim 1, wherein the FVIII protein comprises the sequence of SEQ ID NO: 24.

6. The method of claim 1, wherein the FVIII protein of the FVIII replacement preparation is isolated from plasma.

7. The method of claim 1, wherein the defective FVIII protein comprises a defect of a deletion, an inversion, a nonsense mutation, or a combination thereof.

8. The method of claim 7, wherein the inversion comprises an intron-22 inversion.

9. The method of claim 1, wherein the FVIII protein of the FVIII replacement preparation is a recombinant FVIII.

10. The method of claim 9, wherein the recombinant FVIII is produced from cDNA having a sequence that comprises SEQ ID NO: 3, SEQ ID NO: 4, SEQ ID NO: 5, or SEQ ID NO: 6.

* * * * *